United States Patent 12,508,308 (INFLUENZA mRNA VACCINES) - sequence listing, part 33

SEQ ID NO: 125585 - RNA, 1701 nt, Artificial Sequence
  derived and/or modified sequence opt3 from hemagglutinin__InfluenzaA__ACY77944
augaaggccauccuggugguccuccuuuacaccuucgcuacagcaaacgccgacacucugugcauuggauaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagagucggggaucauaauuucugauacuccagugcaugacugcaauaccacaugucaaaccccgaaaggagcuaucaacacgucccuccccuuccagaauauucacccuaucacuaucggcaagugcccaaaguauguaaaaucaacaaagcugcgccuugccaccggucugagaaacgugcccaguauucagagcaggggguuguuuggagcgauagccggcuucaucgaaggcggguggacuggaauggucgacgguugguacggcuaucaucaccagaaugagcaaggguccggauacgcagcugaucucaaaucuacacagaacgccauugacgagaucaccaauaaggugaacagcguuauagaaaagaugaauacgcaguuuaccgcugugggcaaggaguucaaccaccuggaaaagcggauugagaauuuaaacaaaaaggucgaugacgguuuccuggauaucuggacauacaaugccgaacuccuugugcuguuggagaacgagcgcacucuagacuaucaugauucaaauguuaaaaaccuguacgaaaagguacgaagucagcucaaaaacaaugcaaaggagaucgggaacggcuguuuugaguucuaucacaagugcgacaauaccuguauggaguccgugaaaaacggaacauacgauuauccuaaguacagcgaagaggccaaacugaauagagaggaaauugacggcgucaaacuugagucuacuaggaucuaucaaauucuggcuauauacucaaccguggcgaguagcuugguccucgugguuucccugggggcaaucucuuuuuggaugugcucgaacggcagcuuacagugccggauuuguaucuga

SEQ ID NO: 125586 - RNA, 1701 nt, Artificial Sequence; identical to SEQ ID NO: 124672
  derived and/or modified sequence opt3 from hemagglutinin__InfluenzaA__ACY77954

SEQ ID NO: 125587 - RNA, 1701 nt, Artificial Sequence; identical to SEQ ID NO: 124672
  derived and/or modified sequence opt3 from hemagglutinin__InfluenzaA__ACY77964

SEQ ID NO: 125588 - RNA, 1701 nt, Artificial Sequence; identical to SEQ ID NO: 124672
  derived and/or modified sequence opt3 from hemagglutinin__InfluenzaA__ACY77974

SEQ ID NO: 125589 - RNA, 1701 nt, Artificial Sequence; identical to SEQ ID NO: 124672
  derived and/or modified sequence opt3 from hemagglutinin__InfluenzaA__ACY77984

SEQ ID NO: 125590 - RNA, 1701 nt, Artificial Sequence; identical to SEQ ID NO: 124672
  derived and/or modified sequence opt3 from hemagglutinin__InfluenzaA__ACY77994

SEQ ID NO: 125591 - RNA, 1701 nt, Artificial Sequence
  derived and/or modified sequence opt3 from hemagglutinin__InfluenzaA__ACY79633
augaaggagauccuggugguccuccuuuacaccuucgccacagcuaacgcagacacucugugcauuggcuaucacgccaauaacagcacggauaccguugacacaguguuggagaaaaauguaacugugacccauuccgucaacuuacuggaagauaagcacaaugggaaacuauguaagcucagaggaguggcgccccugcaucuugguaaaugcaacauagcuggcuggauccuggggaauccugaaugugagucuuugucaacagccaguagcugguccuacauuguugaaaccucuucgucagacaacggaacuugcuauccaggcgauuuuaucgacuacgaggagcucagggaacagcugagcaguguguccucuuucgagcgguuugaaauuuucccgaagacaagcuccuggcccaaucacgauucaaacaagggugucaccgcagccuguccucaugcuggggcaaaaaguuuuuauaagaaucugaucuggcucgugaaaaagggaaacagcuacccaaaauuaucuaaguccuauauaaaugacaagggcaaagagguacugguucuuuggggcauccaccaccccucaacgagcgccgaucaacagaguuuguaccagaacgcugacgccuacguguucgucgggacuucucgcuauuccaagaaauuuaagccugagauugcgauccgaccaaaagugcgugaucaggaaggaagaaugaauuacuauuggacccugguggagcccggugacaagauuacauucgaagcaacuggcaaccuagucguuccuagguacgccuuugcuauggagcggaacgcccgcagcgggaucauaauuucggauaccccagugcaugacugcaauacaaccugucaaacgccgaaaggagcaaucaacacuucucuccccuuccagaauauucacccuaucacaaucggcaagugcccaaaguauguaaaauccaccaagcugagacuugcuacuggucugaggaacgugcccucaauucagagucggggguuguuuggagccauagcgggcuucaucgaaggcggguggacaggaauggucgacgguugguacggcuaucaucaccagaaugagcaagggagcggauacgccgcagaucucaaauccacccagaacgcuauugacgagaucacgaauaaggugaacucuguuauagaaaagaugaauacccaguuuacagccgugggcaaggaguucaaccaccuggaaaagcgcauugagaauuuaaacaaaaaggucgaugacgguuuccuggauaucuggacuuacaaugcugaacuccuugugcuguuggagaacgagcgaacccuagacuaucaugauagcaauguuaaaaaccuguacgaaaagguaagaucacagcucaaaaacaaugccaaggagaucgggaacggcuguuuugaguucuaucacaagugcgacaauacauguauggaaagugugaaaaacggaacuuacgauuauccuaaguacuccgaagaggcaaaacugaauagggaggaaauugacggcgucaaacuugagagcacccggaucuaucaaauucuggccauauacucuacaguggcuucaaguuugguccucgugguuagccugggggcgaucuccuuuuggaugugcucuaacggaucguuacagugccguauuuguaucuga

SEQ ID NO: 125592 - RNA, 1701 nt, Artificial Sequence; identical to SEQ ID NO: 125483
  derived and/or modified sequence opt3 from hemagglutinin__InfluenzaA__ACZ01953

SEQ ID NO: 125593 - RNA, 1701 nt, Artificial Sequence
  derived and/or modified sequence opt3 from hemagglutinin__InfluenzaA__ACZ05050
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucggguccagccgcuauucgaagaaauuuaagcccgagauugcaauccgaccuaaagugcgugaucaggagggaagaaugaauuacuauuggacucugguggaaccaggugacaagauuaccuucgaggccacaggcaaccuagucguucccagguacgcuuuugccauggaacggaacgcagggucuggaaucauaauuuccgauacuccugugcaugacugcaauaccacaugucaaaccccaaaaggcgcuaucaacacgucacucccguuccagaauauucaccccaucacuaucgguaagugcccuaaguauguaaaaaguacaaagcugcgccuugccaccgggcugagaaacgugccaagcauucaguccaggggauuguuuggcgcgauagccggcuucaucgaagggggauggacugguauggucgacggcugguacggguaucaucaccagaaugaacaaggaucuggcuacgcagcugaucucaaaagcacacagaacgccauugacgagaucaccaauaaggugaacucaguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauaguaauguuaaaaaccuguacgagaagguacgaucccagcucaaaaacaaugcaaaggaaaucggcaacggauguuuugaguucuaucacaagugcgacaauaccuguauggaaagcgugaaaaacggcacauacgauuaucccaaguacucugaggaagccaaacugaauagagaggagauugacggggucaaacuugaaucaacuaggaucuaucaaauucuggcuauauacaguaccguggcgagcuccuugguccucgugguuucucugggagcaaucucguuuuggaugugcagcaacgguuccuuacagugccggauuuguaucuga

SEQ ID NO: 125594 - RNA, 1701 nt, Artificial Sequence
  derived and/or modified sequence opt3 from hemagglutinin__InfluenzaA__ACZ05061
auggaggccauccuggugguccuccuuuacaccuucacaacugcuaacgcagacacgcugugcauuggcuaucacgccaauaacagcaccgauacaguugacacuguguuggaaaagaauguaaccgugacacauuccgucaacuuacuggaggauaaacacaaugggaagcuauguaaacucagaggaguggcgccccugcaucuugguaagugcaacauagcuggcuggauccuggggaauccugaaugugagucuuugucaaccgccaguagcugguccuacauuguugaaacuucuucgucagacaacggaacaugcuauccaggcgauuuuaucgacuacgaggagcucagggaacagcugagcaguguguccucuuucgagcgguuugaaauuuucccgaaaaccagcuccuggcccaaucacgauucaaacaagggugucacggcagccuguccucaugcuggggcaaagaguuuuuauaaaaaucugaucuggcucgugaagaaaggaaacagcuacccaaaguuaucuaaauccuauauaaaugacaagggcaaggagguacugguucuuuggggcauccaccaccccucaacuagcgccgaucaacagaguuuguaccagaacgcugacgccuacguguucgucgggucuucccgcuauagcaaaaaguuuaaaccugagauugcgauccgaccaaaggugcgugaucaggaaggaagaaugaauuacuauuggacccugguggagcccggugacaaaauuacauucgaagcaacuggcaaccuagucguuccuagguacgccuuugcuauggagcggaacgccgggucgggaaucauaauuucugauaccccagugcaugacugcaauacaaccugucaaacgcucaagggcgcaaucaacacuucccugccguuccagaauauucaccccaucacaaucgguaaaugcccuaaguauguaaagucaaccaaacuucgccuggcuacuggguugagaaacgugccaaguauucagagcaggggacucuuuggcgccauagcgggcuucaucgaagggggauggacagguauggucgacggcugguacggguaucaucaccagaaugagcaaggauccggcuacgccgcagaucugaagucuacccagaacgcuauugacgagaucacgaauaaagugaacagcguuauagaaaagaugaauacccaguuuacagccguggguaaagaguucaaccacuuagaaaagcggauugagaaucugaacaagaaagucgaugacggguuccucgauaucuggacuuacaaugcugaacuucugguguugcuagagaacgagcgcacccuggacuaucaugauucaaauguaaagaaccucuacgaaaaaguucgaagucagcugaagaacaaugccaaagagaucggcaacggauguuuugaguucuaucacaagugcgacaauacauguauggaauccgugaagaacggcacuuacgauuaucccaaauacagcgaagaggcaaaacuuaauagagaggaaauugacggggucaagcuggagucuaccaggaucuaucaaauuuuggccauauacucaacaguggcuaguagccucguccuggugguuuccuuaggagcgaucucuuuuuggaugugcucgaacgguagccugcagugccggauuuguaucuga

SEQ ID NO: 125595 - RNA, 1701 nt, Artificial Sequence; identical to SEQ ID NO: 124672
  derived and/or modified sequence opt3 from hemagglutinin__InfluenzaA__ACZ05071

SEQ ID NO: 125596 - RNA, 1701 nt, Artificial Sequence; identical to SEQ ID NO: 124672
  derived and/or modified sequence opt3 from hemagglutinin__InfluenzaA__ACZ05081

SEQ ID NO: 125597 - RNA, 1701 nt, Artificial Sequence; identical to SEQ ID NO: 124672
  derived and/or modified sequence opt3 from hemagglutinin__InfluenzaA__ACZ05091

SEQ ID NO: 125598 - RNA, 1701 nt, Artificial Sequence; identical to SEQ ID NO: 124672
  derived and/or modified sequence opt3 from hemagglutinin__InfluenzaA__ACZ05101

SEQ ID NO: 125599 - RNA, 1701 nt, Artificial Sequence; identical to SEQ ID NO: 124672
  derived and/or modified sequence opt3 from hemagglutinin__InfluenzaA__ACZ05111

SEQ ID NO: 125600 - RNA, 1701 nt, Artificial Sequence
  derived and/or modified sequence opt3 from hemagglutinin__InfluenzaA__ACZ05121
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaauaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggucuucccgcuauagcaaaaaguuuaaaccugagauugcaauccgaccaaaggugcgugaucaggagggaagaaugaacuacuauuggacucugguggaacccggugacaaaauuaccuucgaggccacaggcaaccuagucguuccuagguacgcuuuugccauggaacggaaugcagggucgggaaucauaauuucugauacuccagugcaugacugcaacaccacaugucaaaccccgaagggcgcuaucaauacgucccuccccuuccagaacauucacccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgacggcugguacggguaucaucaccagaacgaacaaggauccggcuacgcagcugaucucaagucuacacagaaugccauugacgagaucaccaacaaagugaauagcguuauagagaagaugaacacgcaguuuaccgcuguggguaaagaguucaaucaccuggaaaagcggauugaaaacuuaaauaagaaagucgaugacggguuccuggauaucuggacauacaacgccgagcuccuugugcuguuggaaaaugagcgcacucuagacuaucaugauucaaacguaaagaaccuguacgagaaaguucgaagucagcucaagaauaacgcaaaagaaaucggcaauggauguuuugaguucuaucacaagugcgacaacaccuguaugggcuccgugaagaaugggacauacgauuauccuaaauacagcgaagaggccaagcugaacagagaagagauugacggagucaaacuugagucuacuaggaucuaucaaauucuggcuauauacucaaccguggcgaguagcuugguccucgugguuucccugggugcaaucucuuuuuggaugugcucgaauggcagcuuacagugccggauuuguaucuga

SEQ ID NO: 125601 - RNA, 1701 nt, Artificial Sequence; identical to SEQ ID NO: 124672
  derived and/or modified sequence opt3 from hemagglutinin__InfluenzaA__ACZ05131

SEQ ID NO: 125602 - RNA, 1701 nt, Artificial Sequence; identical to SEQ ID NO: 124672
  derived and/or modified sequence opt3 from hemagglutinin__InfluenzaA__ACZ05141

SEQ ID NO: 125603 - RNA, 1701 nt, Artificial Sequence; identical to SEQ ID NO: 124672
  derived and/or modified sequence opt3 from hemagglutinin__InfluenzaA__ACZ05151

SEQ ID NO: 125604 - RNA, 1701 nt, Artificial Sequence
  derived and/or modified sequence opt3 from hemagglutinin__InfluenzaA__ACZ05172
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggcgcuccaagaauagcuuuuucagucgacugaacuggcucacucauuuaaauuuuaaauauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcagacagccaucccaaacauagggucaaggccccggguacgcaauauuccuagcagaaucaguauuuacuggaccaucguuaaaccaggagacauccugcuaauuaacucuacggguaaucucauagcgccgaggggcuacuucaagauccgguccgggaagucaucgauuaugcgcucugacgcacccaucggaaaauguaacuccgagugcauaacuccuaauggcucaauuccaaacgauaagcccuuucagaaugugaaccgaaucacauauggugccuguccuagauacgucaaacaaaauacccugaaacuugcuacugggaugaggaacgugccagaaaaacagacacggggaaucuucggcgccauugcaggcuuuaucgagaaugggugggaaggaaugguggacgguugguauggcuuccgucaccagaacagugaggggcgcggacaagcugccgaucuuaagagcacccaggcggccauugaccagauaaauggcaaauugaacagacucaucgguaagacgaaugagaaguuccaccagauugaaaaagaguuuuccgaagucgaggggaggauccaagaucuggaaaaguacguugaggacaccaaaaucgauuuauggucuuauaacgcagagcugcucguggcucuugaaaaccagcauacaauugaccugacugauagcgagaugaauaaguuguucgaaaagaccaagaagcagcuacgggagaacgccgaagacaugggcaauggaugcuuuaaaauauaccacaagugugauaacgcuugcaucggcucaauucgaaaugggacauaugaccaugacguauaccgcgaugaggcccugaacaauagauuccagaucaaaggaguggagcucaagagugguuacaaagacuggauucuguggaucuccuuugcaauaagcugcuuccuucugugugucgccuugcucggcuuuaucaugugggcuugccaaaaggggaacauuagguguaauaucugcauuuga

SEQ ID NO: 125605 - RNA, 1698 nt, Artificial Sequence; identical to SEQ ID NO: 125147
  derived and/or modified sequence opt3 from hemagglutinin__InfluenzaA__ACZ05194

SEQ ID NO: 125606 - RNA, 1701 nt, Artificial Sequence; identical to SEQ ID NO: 125604
  derived and/or modified sequence opt3 from hemagglutinin__InfluenzaA__ACZ05205

SEQ ID NO: 125607 - RNA, 1701 nt, Artificial Sequence
  derived and/or modified sequence opt3 from hemagglutinin__InfluenzaA__ACZ05216
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgaucaaauugaggugacuaaugcgaccgaauuaguacaguccucuucaacaggugagaucugcgacaguccacaccagauacuggauggcgaaaacuguacccuaaucgacgcucuccugggggauccgcagugcgacggauuucaaaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaaguuuaaguauccagcauuaaacgugaccaugcccaacaaugagcaguucgacaaacuguacaucuggggaguccaccauccuggcacagauaacgaccagauuuuucuuuaugcccaagcuaguggccguaucacugugagcaccaagagaucucagcagacaguaauaccaaauauuggguccaggccccggguucgcaacaucccuucaagaauuagcaucuacuggaccaucgugaaaccaggagauauuuugcugauaaauaguacggguaaccuaaucgccccgaggggcuacuucaagauucggucugggaaauccagcaucaugcgcucggacgcgcccauaggaaaguguaauucugaaugcauuacuccuaacggcuccaucccaaaugacaagcccuuucagaacgucaaucgaaucacauauggugcauguccuagauacgugaaacaaaacacccucaagcuggccacugggaugaggaaugugccagagaaacagacacggggaauuuucggcgcuaucgccggcuuuauugaaaacgggugggagggaauggucgaugguugguauggcuuccgucaccaaaauucagaggggcgcggacaggcagcugaccuuaagaguacccaggccgcgauagaucagaucaacggcaaacugaacagauugauugguaagacgaaugaaaaauuccaccagaucgagaaggaauuuagcgagguugaagggaggauccaagaccucgagaaguacguggaggauaccaaaauugaccugugguccuauaacgccgaauuacugguagcacucgagaaucagcauacaauagaucuuacugacucugaaaugaacaagcuguucgagaaaaccaagaaacaguugcgggaaaaugcugaggauaugggcaacggaugcuuuaagaucuaccacaagugugacaaugccugcauuggcagcauccgaaacgggacauaugaucaugacguguaccgcgacgaggcucuaaauaacagauuccagauuaaaggagucgaacugaagucagguuacaaagauuggauccucuggauaaguuuugccaucuccugcuuccugcuuuguguggcacuguugggcuuuauuaugugggccugccaaaaggggaauaucagguguaacauuugcaucuga

SEQ ID NO: 125608 - RNA, 1701 nt, Artificial Sequence; identical to SEQ ID NO: 125604
  derived and/or modified sequence opt3 from hemagglutinin__InfluenzaA__ACZ05227

SEQ ID NO: 125609 - RNA, 1701 nt, Artificial Sequence
  derived and/or modified sequence opt3 from hemagglutinin__InfluenzaA__ACZ05238
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacugggcugguguuacacagaaugggaccucuagcgcaugcauccggcgcuccaagaacucauuuuucagucgacugaauuggcucacgcauuuaaacuuuaaauauccagcccugaaugugacuaugcccaacaacgagcaguucgacaagcuguacauuuggggaguccaccauccuggcaccgauaaagaccagaucuuuuuguaugcucaagccagcggccguauuacagugucuacuaagagaucccagcagaccgcgaucccaaauauagggucaaggccccggguacgcaacauuccuagcagaaucaguauuuacuggacaaucguuaaaccaggagauauccugcuaauuaauucuaccgguaaccucauagcaccgaggggcuacuucaagauccgguccggaaagagcucgauuaugcgcucugacgcccccaucgggaaauguaauuccgagugcauaacgccuaacggcucaauuccaaaugacaagcccuuucagaacgugaaucgaaucacuuauggugcuuguccuagauacgucaaacaaaacacacugaaacuugccaccgggaugaggaaugugccagaaaaacagacucggggaaucuucggcgcaauugcuggcuuuaucgagaacgggugggaaggaaugguggaugguugguauggcuuccgucaccagaauagugaggggcgcggacaagccgcggaccuuaagagcacacaggccgcaauugaucagauaaacggcaaauugaauagacucaucgguaagaccaacgagaaguuccaccagauugaaaaagaguuuuccgaagucgaggggaggauccaagaccuggaaaaguacguugaggauacgaaaaucgacuuauggucuuauaacgcugagcugcucguggcccuugaaaaucagcauaccauugaucugacagacagcgagaugaacaaguuguucgaaaagacuaagaagcagcuacgggagaaugcugaagauaugggcaacggaugcuuuaaaauauaccacaagugugacaaugccugcaucggcucaauucgaaacgggaccuaugaucaugacguauaccgcgacgaggcacugaauaacagauuccagaucaaaggaguggagcucaagagugguuacaaagauuggauucuguggaucuccuuugccauaagcugcuuccuucugugugucgcuuugcucggcuuuaucaugugggcgugccaaaaggggaauauuagguguaacaucugcauuuga

SEQ ID NO: 125610 - RNA, 1701 nt, Artificial Sequence; identical to SEQ ID NO: 125604
  derived and/or modified sequence opt3 from hemagglutinin__InfluenzaA__ACZ05249

SEQ ID NO: 125611 - RNA, 1701 nt, Artificial Sequence; identical to SEQ ID NO: 125604
  derived and/or modified sequence opt3 from hemagglutinin__InfluenzaA__ACZ05260

SEQ ID NO: 125612 - RNA, 1701 nt, Artificial Sequence
  derived and/or modified sequence opt3 from hemagglutinin__InfluenzaA__ACZ05271
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagcggcagacacguggaaucuucggcgcuauugccggcuuuaucgaaaaugggugggagggaauggucgaugguugguauggcuuccgccaccagaacagugaggggagaggacaagcagcugaccuuaaaagcacccaggccgcgauugaucagauaaauggcaaguugaacaggcucaucgguaaaacgaacgaaaaguuccaccagauugagaaagaauuuuccgagguugaagggcggauccaagaccuggagaaguacguggaggauaccaagaucgacuuauggucuuauaaugccgaacugcucguagcacuugagaaccagcauacaauugaucugacugacagcgaaaugaauaaauuguucgagaagaccaaaaagcagcuacgagaaaacgcugaggauaugggcaauggaugcuuuaaaauauaccacaagugugacaacgccugcaucggcucaauucgcaaugggacauaugaucaugacguguacagagacgaggcucugaacaauagguuccagaucaagggagucgaacucaaaagugguuacaaggauuggauucuguggaucuccuuugccauaagcugcuuccuucuguguguggcauugcucggcuuuaucaugugggccugccaaaaagggaacauucgguguaauaucugcauuuga

SEQ ID NO: 125613 - RNA, 1701 nt, Artificial Sequence
  derived and/or modified sequence opt3 from hemagglutinin__InfluenzaA__ACZ05282
augaagaccacaaucgcccugagcuacauucucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccggugagaucugcgacagcccacaccagauucuagauggcgaaaauuguacucucaucgacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacacuggaauuuaacaaugaguccuucaacuggaccgguguuacgcagaaugggacuucuagcgcuugcauacggcgcuccaacaauucauuuuucagucgacugaacuggcucacccauuuaaaguuuaaguauccagcacugaaugugacaaugcccaacaacgagcaguucgacaaacuuuacaucuggggaguccaccauccuggcacugauaaugaccagaucuuuuuguaugcccaagcuagcggccguauuaccgugucuacaaagagaucccagcagaccguaauuccaaacaucgggucaaggccccggguucgcaauauaccuagcagaauuaguaucuacuggacgauugugaaaccaggagauauccugcuaaucaacucuacugguaaucucauugccccgaggggcuacuucaagauacaguccgggaaaagcucgaucaugcggucugacgcgcccauuggaaaguguaacuccgaaugcaucacaccuaauggcucaauaccaaacgacaagcccuuucaaaaugucaaccgcauuaccuauggugcauguccucgauacgugaaacagaauacucugaagcuggccacagggaugagaaacgugccagagaaacagaccaggggaaucuucggcgcuaucgccggcuuuauugaaaaugggugggagggaauggucgaugguugguauggcuuccggcaccaaaacagugaggggcguggacaggcagcugaccuuaagagcacgcaggccgcgaucgaucagauuaauggcaaauugaaccgccucauagguaagaccaacgaaaaauuccaccaaaucgagaaggaauuuuccgagguugaagggaggauucaggaccuggagaaguacguggaggauacaaaaaucgacuuauggucuuauaaugccgaacugcucguagcacuugagaaccagcauacuaucgaucugaccgacagcgaaaugaauaaguuguucgagaaaacaaagaaacagcuaagagaaaacgcugaggauaugggcaauggaugcuuuaagauuuaccacaagugugacaacgccugcauaggcucaauccggaaugggacuuaugaucaugacguguaccgagacgaggcucugaacaaucgcuuccaaauuaaaggagucgaacucaagagugguuacaaagauuggauccuguggauuuccuuugccaucagcugcuuccuucuguguguggcauugcucggcuuuauaaugugggccugccagaaggggaacaucagauguaauauuugcaucuga

SEQ ID NO: 125614 - RNA, 1701 nt, Artificial Sequence; identical to SEQ ID NO: 125604
  derived and/or modified sequence opt3 from hemagglutinin__InfluenzaA__ACZ05304

SEQ ID NO: 125615 - RNA, 1701 nt, Artificial Sequence; identical to SEQ ID NO: 125427
  derived and/or modified sequence opt3 from hemagglutinin__InfluenzaA__ACZ05315

SEQ ID NO: 125616 - RNA, 1701 nt, Artificial Sequence; identical to SEQ ID NO: 125604
  derived and/or modified sequence opt3 from hemagglutinin__InfluenzaA__ACZ05326

SEQ ID NO: 125617 - RNA, 1701 nt, Artificial Sequence
  derived and/or modified sequence opt3 from hemagglutinin__InfluenzaA__ACZ05337
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcaaaaauuguacucucauagacgcgcugcuuggggauccgcagugcgacggauuucaaaacaagaaaugggaucuguucguggaaagauccaaggcuuauucuaauuguuaccccuaugacgucccugauuacgccucguugaggucacucguggcaagcaguggcacacuggaguuuaacaaugaacgguucaacuggaccgguguuacgcagaaugggacuuccucugccugcauccgccgaagcaagaacuccuuuuucucacgucugaauuggcucacccauuuaaacuuuaaauauccagcucugaaugugacaaugcccaacaacgagcaguucgacaagcuguacauuuggggaguccaccauccuggcacugauaaagaccagaucuuuuuguaugcacaagccaguggcagaauuaccgugagcacaaagaggucucagcagaccguaaucccaaauauagggucccggccccgcguuagaaacauuccuucaaggaucagcauuuacuggacgaucgugaaaccaggagauauccugcuaauuaguucuacugguaaucucauagcuccgcggggcuacuucaagauccgcuccggaaagagcucgauuaugcgaucugacgcccccaucgggaaauguaacuccgagugcauaacaccuaauggcucaauuccaaacgacaagcccuuucagaaugucaacagaaucaccuauggugcguguccuagguacgugaaacaaaauacucugaaacuugcaacagggaugcggaacgugccagaaaaacagacccguggaaucuucggcgccauugcuggcuuuaucgagaaugggugggaaggaauggucgaugguugguauggcuuccgccaccagaacagugaggggagaggacaagccgcagaccuuaagagcacgcaggcugccauugaucagauaaauggcaaauugaacaggcucaucgguaagaccaaugagaaguuccaccagauugaaaaagaguuuuccgaaguugaggggcggauccaagaccuggaaaaguacguggaggauacaaaaaucgacuuauggucuuauaacgcggagcugcucguagcccuugaaaaccagcauacuauugaucugaccgacagcgagaugaauaaguuguucgaaaagacaaagaagcagcuacgagagaacgcagaagauaugggcaauggaugcuuuaaaauauaccacaagugugacaacgcuugcaucggcucaauucgcaaugggacuuaugaucaugacguguacagagacgaggcccugaacaauagguuccagaucaaaggagucgagcucaagagugguuuuaaagauuggauucuguggaucuccuucgcuauaagcugcuuucuucuguguguggccuugcucggcuucaucaugugggcaugccaaaaggggaacauucgguguaauaucugcauuuga

SEQ ID NO: 125618 - RNA, 1701 nt, Artificial Sequence; identical to SEQ ID NO: 125604
  derived and/or modified sequence opt3 from hemagglutinin__InfluenzaA__ACZ05348

SEQ ID NO: 125619 - RNA, 1701 nt, Artificial Sequence; identical to SEQ ID NO: 125609
  derived and/or modified sequence opt3 from hemagglutinin__InfluenzaA__ACZ05359

SEQ ID NO: 125620 - RNA, 1701 nt, Artificial Sequence; identical to SEQ ID NO: 125604
  derived and/or modified sequence opt3 from hemagglutinin__InfluenzaA__ACZ05370

SEQ ID NO: 125621 - RNA, 1701 nt, Artificial Sequence
  derived and/or modified sequence opt3 from hemagglutinin__InfluenzaA__ACZ05392
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaauggggcuucuagcgcaugcauccggcgcuccaagaacucauuuuucagucgacugaauuggcucacgcauuuaaacuuuaaauauccagcccugaaugugacuaugcccaacaacgagcaguucgacaagcuguacauuuggggaguccaccauccuggcaccgauaaagaccagaucuuuuuguaugcucaagccagcggccguauuacagugucuacuaagagaucccagcagaccgcgaucccaaauauagggucaaggccccggguacgcaacauuccuagcagaaucaguauuuacuggacaaucguuaaaccaggagauauccugcuaauuaauucuaccgguaaccucauagcaccgaggggcuacuucaagauccgguccggaaagagcucgauuaugcgcucugacgcccccaucgggaaauguaauuccgagugcauaacgccuaacggcucaauuccaaaugacaagcccuuucagaacgugaaucgaaucacuuauggugcuuguccuagauacgucaaacaaaacacacugaaacuugccaccgggaugaggaaugugccagaaaaacagacucggggaaucuucggcgcaauugcuggcuuuaucgagaacgggugggaaggaaugguggaugguugguauggcuuccgucaccagaauagugaggggcgcggacaagccgcggaccuuaagagcacacaggccgcaauugaucagauaaacggcaaauugaauagacucaucgguaagaccaacgagaaguuccaccagauugaaaaagaguuuuccgaagucgaggggaggauccaagaccuggaaaaguacguugaggauacgaaaaucgacuuauggucuuauaacgcugagcugcucguggcccuugaaaaucagcauaccauugaucugacagacagcgagaugaacaaguuguucgaaaagacuaagaagcagcuacgggagaaugcugaagauaugggcaacggaugcuuuaaaauauaccacaagugugacaaugccugcaucggcucaauucgaaacgggaccuaugaucaugacguauaccgcgacgaggcacugaauaacagauuccagaucaaaggaguggagcucaagagugguuacaaagauuggauucuguggaucuccuuugccauaagcugcuuccuucugugugucgcuuugcucggcuuuaucaugugggcgugccaaaaggggaauauuagguguaacaucugcauuuga

SEQ ID NO: 125622 - RNA, 1701 nt, Artificial Sequence; identical to SEQ ID NO: 125604
  derived and/or modified sequence opt3 from hemagglutinin__InfluenzaA__ACZ05403

SEQ ID NO: 125623 - RNA, 1701 nt, Artificial Sequence
  derived and/or modified sequence opt3 from hemagglutinin__InfluenzaA__ACZ05436
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaauccuguacccucauagacgcucugcuuggggauccgcagugcgacggauuucaaaauaagaaaugggaucuguucguggaaagaucuaaggccuauucgaacuguuaccccuaugacgucccugauuacgcaucauugaggagccucguggccaguuccggcacucuggaguuuaauaacgaaucuuucaauuggacagguguuacccagaacgggacgagcuccgcuugcauccggcgcucaaagaauagcuuuuucagucgacugaacuggcucacucauuuaaauuuuaaauauccagcacugaacgugaccaugcccaauaacgagcaguucgacaaacuuuacauuuggggaguccaccauccuggcacagauaaagaccagaucuuuuuguaugcccaggcuucuggccguauuacuguguccaccaagagaucacaacagacagccaucccaaacauagggagcaggccccggguacgcaauauuccuaguagaaucucuauuuacuggaccaucguuaaaccaggagauauccugcuaauuaacuccacggguaaucucauagcgccgaggggcuacuucaagauccggagcgggaagucgucuauuaugcgcuccgacgcacccaucggaaaauguaacucagagugcauaacuccuaauggcaguauuccaaacgacaagcccuuucagaaugugaaccgaaucacauauggugccuguccuagauacgucaaacaaaauacccugaaacuugcuacugggaugaggaacgugccagaaaagcagacacggggaaucuucggcgccauugcaggcuuuaucgagaaugggugggaaggaaugguggaugguugguauggcuuccgucaccagaacagcgaggggcgcggacaagcugccgaccugaaguccacccaggcggccauugaucagauaaauggcaaauugaacagacucaucgguaagacgaaugagaaguuccaccagauugaaaaagaguuuucugaagucgaggggaggauccaagaccuggaaaaguacguugaggauaccaaaaucgacuuauggagcuauaacgcagagcugcucguggcucuugaaaaccagcauacaauugaucugacugacucagagaugaauaaguuguucgaaaagaccaagaagcagcuacgggagaacgccgaagauaugggcaauggaugcuuuaaaauauaccacaagugugacaacgcuugcaucggcaguauucgaaaugggacauaugaucaugacguauaccgcgacgaggcccugaacaauagauuccagaucaaaggaguggagcucaaguccgguuacaaagauuggauucuguggaucagcuuugcaauaucuugcuuccuucugugugucgccuugcucggcuuuaucaugugggcuugccaaaaggggaacauuagguguaauaucugcauuuga

SEQ ID NO: 125624 - RNA, 1701 nt, Artificial Sequence; identical to SEQ ID NO: 125604
  derived and/or modified sequence opt3 from hemagglutinin__InfluenzaA__ACZ05458

SEQ ID NO: 125625 - RNA, 1701 nt, Artificial Sequence; identical to SEQ ID NO: 125604
  derived and/or modified sequence opt3 from hemagglutinin__InfluenzaA__ACZ05469

SEQ ID NO: 125626 - RNA, 1701 nt, Artificial Sequence; identical to SEQ ID NO: 125623
  derived and/or modified sequence opt3 from hemagglutinin__InfluenzaA__ACZ05480

SEQ ID NO: 125627 - RNA, 1701 nt, Artificial Sequence; identical to SEQ ID NO: 125427
  derived and/or modified sequence opt3 from hemagglutinin__InfluenzaA__ACZ05513

SEQ ID NO: 125628 - RNA, 1701 nt, Artificial Sequence; identical to SEQ ID NO: 125604
  derived and/or modified sequence opt3 from hemagglutinin__InfluenzaA__ACZ05524

SEQ ID NO: 125629 - RNA, 1701 nt, Artificial Sequence
  derived and/or modified sequence opt3 from hemagglutinin__InfluenzaA__ACZ05535
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauugaucugacugacagcgagaugaacaaguuguucgaaaagaccaagaagcagcuacgggagaaugccgaagauaugggcaacggaugcuuuaaaauauaccacaagugugacaaugcuugcaucggcucaauucgaaacgggacauaugaucaugacguauaccgcgacgaggcccugaauaacagauuccagaucaaaggaguggagcucaagagugguuacaaagauuggauucuguggaucuccuuugcaauaagcugcuuccuucugugugucgccuugcucggcuuuaucaugugggcuugccaaaaggggaauauuagguguaacaucugcauuuga

SEQ ID NO: 125630 - RNA, 1701 nt, Artificial Sequence; identical to SEQ ID NO: 125629
  derived and/or modified sequence opt3 from hemagglutinin__InfluenzaA__ACZ05546

SEQ ID NO: 125631 - RNA, 1701 nt, Artificial Sequence; identical to SEQ ID NO: 125604
  derived and/or modified sequence opt3 from hemagglutinin__InfluenzaA__ACZ05557

SEQ ID NO: 125632 - RNA, 1698 nt, Artificial Sequence
  derived and/or modified sequence opt3 from hemagglutinin__InfluenzaA__ACZ05579
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucacccccgaaauagcuaagcguccuaaagugagagaucaggagggcaggaucaacuacuauuggacacuucuggagccaggggacacuauuaucuuugaagcaaauggaaacuugauugccccgcgguacgcuuucgcccucucucgcgguuuuggcuccgggaucauaaauagcaacgcgcccauggauaagugugacgcaaaaugccagaccccuagaggagccauuaauucgucucugccauuccaaaacguacaccccgugacaaucggcgaguguccuaaguaugucagguccgcuaaauuacggauggugaccggucugcgcaauauuccaucaauccagagucgagggcucuuuggagccaucgcaggcuucauugaaggcggguggacgggaaugguugaugguugguacggcuaucaucaccagaacgagcaggggagcggauacgcugccgaccaaaaguccacucagaaugcgauaaacggcaucacaaauaaagugaacucugucauugaaaagaugaauacccaguuuacugccguggguaaggaguucaacaaacuugagagaaggauggaaaaccugaauaagaaaguagaugacggguucaucgauauauggacauacaacgcagaguugcuaguucugcucgaaaaugagcggacccuggacuuucacgacagcaacgugaagaaucuuuaugaaaaagucaagucacagcugaagaacaaugcuaaagagauuggcaacggaugcuucgaguuuuaccauaaguguaaugaugaaugcauggagagugugaaaaacggcacguaugacuaccccaaguauuccgaagagagcaaauugaaucgugagaagaucgauggggucaagcucgaaucuaugggaguguaccaaauccuggccauuuauucaaccguugcuaguagcuuagugcugcuaguaucccucggugccaucucuuucuggaugugcucgaacggcagccugcagugucgcauuugcauauga

SEQ ID NO: 125633 - RNA, 1698 nt, Artificial Sequence
  derived and/or modified sequence opt3 from hemagglutinin__InfluenzaA__ACZ05590
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccauccaucucagaccagaaaacgcuguaccauacugaggaugccuacgucagcguggugaguucucacuauucccgcaaguucacccccgaaauagcuaagcgaccuaaaguccgugaccaggaggggagaaucaacuacuauuggacacuucuggagccaggagauacuauuaucuuugaagcaaaugguaacuugauugccccgagguacgcuuucgcccucagccggggcuuugggucgggaaucauaaauucuaacgcgcccaugggcaagugugacgcaaaaugccagaccccucaaggugccauuaauuccucacugccauuccagaacguucaucccgugacaaucggggaguguccuaaguauguacgcagugcuaaauuaagaauggugaccggacugaggaauauuccaagcauccagucccggggccucuuuggcgccaucgcaggguucauugaaggagguuggacgggcauggucgaugggugguacggauaucaccaccagaacgagcaaggcucugguuacgcugccgaccagaaaagcacucagaaugcgauaaacgggaucacaaauaaagugaacucaguuauugaaaagaugaauacccaguuuacugccgugggcaaggaguucaacaaacuugagcgccgaauggaaaaucugaacaagaaagucgaugacggauucaucgauauauggacauacaacgcagaguugcuagugcugcucgaaaaugagagaacccuggacuuucaugacaguaacguaaagaaucuuuaugaaaaaguuaagucccaacugaagaacaaugcuaaagagauuggcaacgggugcuucgaguuuuaccacaaguguaaugaugaaugcauggagagcgugaaaaacggaacguaugacuaccccaaguauucugaagagucaaaauugaauagggagaagaucgauggugucaagcucgaaaguaugggcguguaccagauccuggccauuuauagcaccgucgcuuccucuuuagugcugcuaguuucgcucggggccaucagcuucuggaugugcuccaacggaucacugcagugucggauuugcauauga

SEQ ID NO: 125634 - RNA, 1701 nt, Artificial Sequence; identical to SEQ ID NO: 125629
  derived and/or modified sequence opt3 from hemagglutinin__InfluenzaA__ACZ05950

SEQ ID NO: 125635 - RNA, 1701 nt, Artificial Sequence; identical to SEQ ID NO: 125604
  derived and/or modified sequence opt3 from hemagglutinin__InfluenzaA__ACZ05961

SEQ ID NO: 125636 - RNA, 1701 nt, Artificial Sequence
  derived and/or modified sequence opt3 from hemagglutinin__InfluenzaA__ACZ05972
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauugaucugacugacagcgagaugaacaaguuguucgaaaagaccaagaagcagcuacgggagaaugccgaagauaugggcaacggaugcuuuaaaauauaccacaagugugacaaugcuugcaucggcucaauucgaaacgggacauaugaucaugacguauaccgcgacgaggcccugaauaacagauuccagaucaaaggaguggagcucaagagugguuacaaagauuggauucuguggaucuccuuugcaauaagcugcucucuucugugugucgccuugcucggcuucaucaugugggcuugccaaaaggggaauauuagguguaacaucugcauuuga

SEQ ID NO: 125637 - RNA, 1701 nt, Artificial Sequence
  derived and/or modified sequence opt3 from hemagglutinin__InfluenzaA__ACZ05983
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaacacauauggugccuguccuagauacgucaaacaaaauacccugaaacuugcuacugggaugaggaacgugccagaaaaacagacacggggaaucuucggcgccaucgcaggcuuuauugagaaugggugggaaggaaugguggaugguugguauggcuuccgucaccagaacagugaggggcgcggacaagcugccgaccuuaagagcacccaggcggccaucgaucagauuaauggcaaauugaacagacucauagguaagacgaacgagaaguuccaccagaucgaaaaagaguuuuccgaagucgaggggaggauucaagaccuggaaaaguacguugaggauaccaaaaucgacuuauggucuuauaaugcagagcugcucguggcucuugaaaaccagcauacaaucgaucugacugacagcgagaugaauaaguuguucgaaaagaccaagaagcagcuacgggagaacgccgaagauaugggcaauggaugcuuuaaaauuuaccacaagugugacaacgcuugcauaggcucaauccgaaaugggacauaugaucaugacguauaccgcgacgaggcccugaacaauagauuccagauuaaaggaguggagcucaagagugguuacaaagauuggauccuguggauuuccuuugcaaucagcugcuuccuucugugugucgccuugcucggcuuuauaaugugggcuugccaaaaggggaacaucagguguaauauuugcaucuga

SEQ ID NO: 125638 - RNA, 1701 nt, Artificial Sequence
  derived and/or modified sequence opt3 from hemagglutinin__InfluenzaA__ACZ05994
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccguccccaacaacgagcaguucgacaagcuguacauuuggggagugcaccauccuggcacagauaaagaccagaucuuuuuguaugcccaagcuagcggccguauuacuguaucuaccaagagaucccagcagacagccaucccaaauauagggucaaggccccggguucgcaacauuccuagcagaaucaguauuuacuggaccaucgugaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgucaaucgaaucacauauggugccuguccuagauacgugaaacaaaacacccugaaacuugcuacugggaugaggaaugugccagaaaaacagacacggggaaucuucggcgccauugcaggcuuuaucgagaacgggugggaaggaauggucgaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaaguugaggggaggauccaagaccuggaaaaguacguggaggauaccaaaaucgacuuauggucuuauaacgcagagcugcucguagcucuugaaaaucagcauacaauugaucugacugacagcgagaugaacaaguuguucgaaaagaccaagaagcagcuacgggagaaugccgaagauaugggcaacggaugcuuuaaaauauaccacaagugugacaaugcuugcaucggcucaauucgaaacgggacauaugaucaugacguguaccgcgacgaggcccugaauaacagauuccagaucaaaggagucgagcucaagagugguuacaaagauuggauucuguggaucuccuuugcaauaagcugcuuccuucuguguguggccuugcucggcuuuaucaugugggcuugccaaaaggggaauauuagguguaacaucugcauuuga

SEQ ID NO: 125639 - RNA, 1701 nt, Artificial Sequence; identical to SEQ ID NO: 125604
  derived and/or modified sequence opt3 from hemagglutinin__InfluenzaA__ACZ06005

SEQ ID NO: 125640 - RNA, 1701 nt, Artificial Sequence; identical to SEQ ID NO: 125604
  derived and/or modified sequence opt3 from hemagglutinin__InfluenzaA__ACZ06016

SEQ ID NO: 125641 - RNA, 1698 nt, Artificial Sequence
  derived and/or modified sequence opt3 from hemagglutinin__InfluenzaA__ACZ16013
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaaguucuaguacucuggggcgugcaccacccuccaaauaucgccgaccagaaaacgcuguaccauacugagaaggcuuacgucucugugguguccucacacuauagccgcaaguucacccccgaaauagcaaaacgaccuaagguccgugaucaggaggggagaaucaacuacuauuggacacuucuggagccaggagacacuauuaucuuugaagccaaugguaacuugauugcuccgagguacgccuucgcgcucagucggggcuuugggucuggaaucauaaauuccaacgcacccauggauaaaugugacgccaagugccagaccccucaaggcgcuauuaauagcucgcugccauuccagaacguucaucccgugacaaucggugaguguccuaaauauguacgcucugccaaguuaagaauggugaccgggcugaggaauauuccauccauccagucacggggacucuuuggcgcaaucgcuggcuucauugaagggggauggacggguauggucgauggcugguacggguaucaccaccagaacgagcaaggaaguggcuacgccgcggaccagaaaagcacucagaaugccauaaacgguaucacaaauaaggugaacuccguuauugaaaagaugaauacccaguuuacugcaguggggaaagaguucaacaaacuugagcgccgaauggaaaaccugaauaaaaaggucgaugacggcuucaucgauauauggacauacaacgcugaguugcuagugcugcucgaaaaugagagaacccuggacuuucaugacucuaacguuaaaaaucuuuaugaaaagguaaagagccaacugaaaaacaaugccaaggagauuggaaacggcugcuucgaguuuuaccacaaauguaaugaugaaugcauggagucagugaagaacgggacguaugacuaccccaaauauagugaagaguccaaguugaauagggagaagaucgauggagucaaacucgaaagcauggguguguaccagauccuggcuauuuauucuaccgucgccucaaguuuagugcugcuaguuagccucggcgcaaucuccuucuggaugugcucuaacgggucgcugcagugucggauuugcauauga

SEQ ID NO: 125642 - RNA, 1698 nt, Artificial Sequence
  derived and/or modified sequence opt3 from hemagglutinin__InfluenzaA__ACZ16023
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacgccaaaugccagaccccucaaggcgcuauuaacagcucgcugccauuccagaauguucaucccgugacaaucggugaguguccuaaguauguacgcucugccaaauuaagaauggugaccgggcugaggaacauuccauccauccagucacggggacucuuuggcgcaaucgcuggcuucauugaagggggauggacggguauggucgauggcugguacggguaucaccaccagaaugagcaaggaaguggcuacgccgcggaccagaaaagcacucagaacgccauaaaugguaucacaaacaaaguaaauuccguuauugaaaagaugaacacccaguuuacugcaguggggaaggaguucaacaaacuugagcgccgaauggaaaaucugaacaagaaagucgaugacggcuucaucgauauauggacauacaaugcugaguugcuagugcugcucgaaaacgagagaacccuggacuuucaugacucuaauguaaagaaccuuuaugaaaaaguuaagagccaacugaagaauaacgccaaagagauuggaaauggcugcuucgaguuuuaccacaaguguaacgaugaaugcauggagucagugaaaaaugggacguaugacuaccccaaguauagugaagaguccaaauugaacagggagaagaucgauggagucaagcucgaaagcauggguguguaccagauccuggcuauuuauucuaccgucgccucaaguuuagugcugcuaguuagccucggcgcaaucuccuucuggaugugcucuaaugggucgcugcagugucggauuugcauauga

SEQ ID NO: 125643 - RNA, 1698 nt, Artificial Sequence
  derived and/or modified sequence opt3 from hemagglutinin__InfluenzaA__ACZ16033
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugucauccuucgaaagguuugagauuuucccuaaggagaguuccuggccaaaccacacugucacaggugccucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcugaccagaaaacgcuguaccauacugagaacgcauacgugucugucguguccucacacuauagccgcaaguucacccccgaaauagccaagcgaccuaaagugcgugaucaggaggggagaaucaauuacuauuggacacuucuggagccaggagacacuauuaucuuugaagcuaacgguaauuugauugccccgagguacgcguucgcacucagucggggcuuugggucuggaaucauaaacuccaaugcccccauggauaagugugacgcuaaaugccagaccccucaaggcgccauuaacagcucgcugccauuccagaauauccaucccgucacaauuggugaguguccuaaguauguucgcucugcaaaauuaagaauggugaccgggcugaggaacaucccauccauccagucacggggacucuuuggcgcuauugccggcuucauagaagggggauggacggguaugguagauggcugguacggguaucaccaccagaaugagcaaggaaguggcuacgcggccgaccagaaaagcacucagaacgcaaucaaugguauuacaaacaaagugaauagcgucaucgaaaagaugaacacccaguuuacugcuguggggaaggaguucaacaaacuugagcgccgaauggaaaaucugaacaagaaaguugaugacggcuucauagauauuuggacauacaaugccgaguugcuagugcugcucgaaaacgagagaacccuggacuuucaugacucuaaugucaagaaccuuuaugaaaaaguaaagagccaacugaagaauaacgcuaaagagaucggaaauggcugcuucgaguuuuaccacaaguguaacgaugaaugcauggagucagugaaaaaugggacguaugacuaccccaaguauagugaagaguccaaauugaacaaggagaagaucgauggaguuaaacucgaaagcauggguguguaccagauucuggccaucuauucuaccgucgcaucaaguuuagugcugcuagucagccucggcgccauuuccuucuggaugugcucuaaugggucgcugcaguguaggauaugcaucuga

SEQ ID NO: 125644 - RNA, 1701 nt, Artificial Sequence; identical to SEQ ID NO: 124672
  derived and/or modified sequence opt3 from hemagglutinin__InfluenzaA__ACZ16040

SEQ ID NO: 125645 - RNA, 1701 nt, Artificial Sequence; identical to SEQ ID NO: 124672
  derived and/or modified sequence opt3 from hemagglutinin__InfluenzaA__ACZ16050

SEQ ID NO: 125646 - RNA, 1701 nt, Artificial Sequence; identical to SEQ ID NO: 124672
  derived and/or modified sequence opt3 from hemagglutinin__InfluenzaA__ACZ16060

SEQ ID NO: 125647 - RNA, 1701 nt, Artificial Sequence
  derived and/or modified sequence opt3 from hemagglutinin__InfluenzaA__ACZ16070
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucucuuuacuggaagauaagcacaacgggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaacuugcuauccaggcgauuuuaucgacuacgaggagcucagggagcagcugaguuccgugucuagcuucgaacgguuugagauuuucccgaagacauccucauggcccaaccacgauaguaauaagggugucaccgccgcuuguccucaugcaggggccaagagcuuuuauaagaaccugaucuggcucgugaaaaagggaaauucuuacccaaaauuauccaagucauauauaaacgacaagggcaaagaaguacugguucuuuggggcauccaccaccccagcacgagugcugaucaacagucuuuguaccagaaugccgacgcguacguguucgucggguccagccgcuauucgaagaaauuuaagccugagauugcaauccgaccaaaagugcgugaucaggagggaagaaugaacuacuauuggacucugguggaacccggugacaagauuaccuucgaggccacaggcaaucuagucguuccuagguacgcuuuugccauggaacggaacgcagggucuggaaucauaauuuccgauacuccagugcaugacugcaacaccacaugucaaaccccgaaaggcgcuaucaauacgucacuccccuuccagaacauucacccuaucacuaucgguaagugcccaaaguauguaaaaaguacaaagcugcgccuugccaccgggcugagaaaugugcccagcauucaguccaggggauuguuuggcgcgauagccggcuucaucgaagggggauggacugguauggucgacggcugguacggguaucaucaccagaacgaacaaggaucuggcuacgcagcugaucucaaaagcacacagaaugccauugacgagaucaccaacaagguaaauucaguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauaguaacgugaaaaaucuguacgagaagguucgaucccagcucaaaaacaacgcaaaggaaaucggcaauggauguuuugaguucuaucacaagugcgacaacaccuguauggaaagcgugaaaaauggcacauacgauuauccuaaguacucugaggaagccaaacugaacagagaggagauugacggggucaaacuugaaucaacuaggaucuaucaaauucuggcuauauacaguaccguggcgagcuccuugguccucgugguuucucugggagcaaucucguuuuggaugugcagcaaugguuccuuacagugccggauuuguaucuga

SEQ ID NO: 125648 - RNA, 1701 nt, Artificial Sequence
  derived and/or modified sequence opt3 from hemagglutinin__InfluenzaA__ACZ16080
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgaugggucgggaaucauaauuucugacacuccagugcaugacugcaauaccacaugucaaaccccgaaaggcgcaaucaacacgucccuccccuuccagaauauucacccuaucacuaucgguaagugcccaaaguauguaaaaucaacaaagcugcgccuugcuaccgggcugagaaacgugcccaguauucagagcaggggauuguuuggcgccauagcgggcuucaucgaagggggauggacugguauggucgauggcugguacggguaucaucaccagaaugaacaaggauccggcuacgccgcagaccucaaaucuacacagaacgcuauugaugagaucaccaauaaggugaacagcguuauagagaaaaugaauacgcaguuuaccgccguggguaaggaguucaaccaccuggaaaagcggauugaaaauuuaaacaaaaaggucgacgauggguuccuggacaucuggacauacaaugcugagcuccuugugcuguuggaaaacgagcgcacucuagauuaucaugacucaaauguaaagaaccuguacgagaagguucgaagucagcucaaaaacaaugccaaggaaaucggcaacggauguuuugaguucuaucacaagugcgauaauaccuguauggaauccgugaaaaacggcacauacgacuauccuaaguacagcgaggaagcaaaacugaauagagaggagauugauggggucaaacuugaaucuacuaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 125649 - RNA, 1701 nt, Artificial Sequence
  derived and/or modified sequence opt3 from hemagglutinin__InfluenzaA__ACZ16090
augaaggccauccugcucgugcuucuguacaccuucgcuacagcaaacgccgacacuuugugcauuggcuaucacgcgaauaacagcacggauaccgucgacacaguuuuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaggagcugagggagcagcugagcaguauguccucuuucgaacgguuugagauuuucccgaagacaagcuccuggcccaaucacgauucaaacaaggguguuaccgccgcuuguccucaugcaggggccaaaaguuuuuauaagaaucucaucugguuagugaaaaagggaaacagcuacccaaaacugucuaaguccuauauaaaugacaagggcaaagaaguccuuguguuguggggcauccaccaccccucaacgagcgcugaucaacagagucuguaccagaacgccgacgcguacguauucguugggucuucccgcuauagcaagaaauuuaagccugagauugcaauccgaccaaaagugcgugaucaggagggaagaaugaauuacuauuggacucuagucgaacccggugacaagauuaccuucgaggccacaggcaaccucguggugccuagguacgcuuuugccauggaacggaacgcagggucgggaaucauaauuucugauacuccaguccaugacugcaauaccacaugucaaaccccgaaaggcgcuaucaacacgucccugcccuuccagaauauucacccuaucacuaucgguaagugcccaaaguauguuaaaucaacaaaacuucgccuggccaccggguugagaaacgugcccaguauucagagcaggggacucuuuggcgcgauagccggcuucaucgaagggggauggacugguaugguagacggcugguacggguaucaucaccagaaugaacaaggauccggcuacgcagcugaucugaaaucuacacagaacgccauugacgagaucaccaauaaggugaacagcgucauagagaaaaugaauacgcaguuuaccgcuguggguaaggaguucaaccacuuagaaaagcggauugaaaaucugaacaaaaagguugaugacggguuccucgauaucuggacauacaaugccgagcuucugguguugcuagaaaacgagcgcacucuggacuaucaugauucaaaugucaaaaaccucuacgagaaggugcgaagucagcugaaaaacaaugcaaaggaaaucggcaacggauguuuugaguucuaucacaagugcgacaauaccuguauggaauccguaaagaacggcacauacgauuauccuaaguacagcgaggaagccaaacuuaauagagaggagauugacgggguuaagcuggaaucuacuaggaucuaucaaauuuuggcuauauacucaaccguggcgaguagccucguccugguggucuccuuaggagcaaucucuuuuuggaugugcucgaacgguagccugcagugccggauuuguaucuga

SEQ ID NO: 125650 - RNA, 1701 nt, Artificial Sequence; identical to SEQ ID NO: 124672
  derived and/or modified sequence opt3 from hemagglutinin__InfluenzaA__ACZ16100

SEQ ID NO: 125651 - RNA, 1701 nt, Artificial Sequence; identical to SEQ ID NO: 124672
  derived and/or modified sequence opt3 from hemagglutinin__InfluenzaA__ACZ16110

SEQ ID NO: 125652 - RNA, 1701 nt, Artificial Sequence; identical to SEQ ID NO: 124672
  derived and/or modified sequence opt3 from hemagglutinin__InfluenzaA__ACZ16120

SEQ ID NO: 125653 - RNA, 1701 nt, Artificial Sequence; identical to SEQ ID NO: 125420
  derived and/or modified sequence opt3 from hemagglutinin__InfluenzaA__ACZ16130

SEQ ID NO: 125654 - RNA, 1701 nt, Artificial Sequence; identical to SEQ ID NO: 124672
  derived and/or modified sequence opt3 from hemagglutinin__InfluenzaA__ACZ16140

SEQ ID NO: 125655 - RNA, 1701 nt, Artificial Sequence; identical to SEQ ID NO: 124672
  derived and/or modified sequence opt3 from hemagglutinin__InfluenzaA__ACZ16150

SEQ ID NO: 125656 - RNA, 1701 nt, Artificial Sequence; identical to SEQ ID NO: 124672
  derived and/or modified sequence opt3 from hemagglutinin__InfluenzaA__ACZ16160

SEQ ID NO: 125657 - RNA, 1701 nt, Artificial Sequence; identical to SEQ ID NO: 124865
  derived and/or modified sequence opt3 from hemagglutinin__InfluenzaA__ACZ16170

SEQ ID NO: 125658 - RNA, 1701 nt, Artificial Sequence
  derived and/or modified sequence opt3 from hemagglutinin__InfluenzaA__ACZ16180
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuguacacagcaucaaguuggagcuauauuguugagaccuccucuucggacaacggaacuugcuacccaggcgauuuuaucgacuaugaggagcucagggagcagcugucaagcgugaguuccuucgaacgguuugagauuuucccgaagacaucuagcuggcccaaucacgauuccaacaagggugucaccgccgcuuguccucaugcaggggccaaaucauuuuacaagaaucugaucuggcucgugaaaaagggaaacaguuauccaaaauuaagcaagucuuacauaaaugacaagggcaaagaaguacugguucuuuggggcauccaccaccccuccacgucagcugaucaacagagcuuguaccagaacgccgacgcguauguguucgucgggaguucucgcuacuccaagaaauuuaagccugagauugcaauccgaccaaaagugcgugaucaggagggaagaaugaauuauuacuggacucugguggaacccggugacaagauuaccuucgaggccacaggcaaccuagucguuccuagguaugcuuuugccauggaacggaacgcagggagcggaaucauaauuucggauacuccagugcaugacugcaauaccacaugucaaaccccgaaaggcgcuaucaacacgucucuccccuuccagaauauucacccuaucacuaucgguaagugcccaaaguacguaaaauccacaaagcugcgccuugccaccgggcugagaaacgugcccucaauucagaguaggggauuguuuggcgcgauagccggcuucaucgaagggggauggacugguauggucgacggcugguauggguaccaucaccagaaugaacaaggaagcggcuacgcagcugaucucaaauccacacagaacgccauugacgagaucaccaauaaggugaacucuguuauagagaaaaugaauacgcaguuuaccgcuguggguaaggaguucaaccaccuggaaaagcggauugaaaauuuaaacaaaaaggucgaugacggguuccuggauaucuggacauauaaugccgagcuccuugugcuguuggaaaacgagcgcacucuagacuaccaugauagcaauguaaagaaccuguaugagaagguucgaucacagcucaaaaacaaugcaaaggaaaucggcaacggauguuuugaguucuaccacaagugcgacaauaccuguauggaaagugugaaaaacggcacauaugauuacccuaaguauuccgaggaagccaaacugaauagagaggagauugacggggucaaacuugaaagcacuaggaucuaccaaauucuggcuauauacucuaccguggcgucaaguuugguccucgugguuagccugggagcaaucuccuuuuggaugugcucuaacgguucguuacagugccggauuuguaucuga

SEQ ID NO: 125659 - RNA, 1701 nt, Artificial Sequence; identical to SEQ ID NO: 124672
  derived and/or modified sequence opt3 from hemagglutinin__InfluenzaA__ACZ16190

SEQ ID NO: 125660 - RNA, 1701 nt, Artificial Sequence
  derived and/or modified sequence opt3 from hemagglutinin__InfluenzaA__ACZ16200
augaaggccauccuggugguccuccuuuacaccuucgcuacagcaaaccccgacacucugugcauuggcuaucacgccaauaacagcacggauaccguugacacaguguuggagaaaaauguaacugugacccauuccgucaacuuacuggaagauaagcacaaugggaaacuauguaagcucagaggaguggcgccucugcaucuugguaaaugcaacauagcuggcuggauccuggggaauccagagugugaaucuuugucaacagccaguagcugguccuacauuguugagaccucuucgucagacaacggaacuugcuauccgggcgauuuuaucgacuacgaggagcucagggagcagcugagcaguguguccucuuucgaacgguuugagauuuuccccaagacaagcuccuggccuaaucacgauucaaacaagggugucaccgcagccuguccacaugcuggggcaaaaaguuuuuauaagaaucugaucuggcucgugaaaaagggaaacagcuaccccaaauuaucuaaguccuauauaaaugacaagggcaaagaaguacugguucuuuggggcauccaccacccuucaacgagcgccgaucaacagaguuuguaccagaacgcugacgccuacguguucgucgggucuucccgcuauagcaagaaauuuaagccagagauugcgauccgacccaaagugcgugaucaggagggaagaaugaauuacuauuggacucugguggaaccuggugacaagauuaccuucgaggcaacaggcaaccuagucguuccaagguacgccuuugcuauggaacggaacgccgggucgggaaucauaauuucugauacuccggugcaugacugcaauaccacaugucaaacccccaaaggcgcaaucaacacgucccucccuuuccagaauauucacccaaucacuaucgguaagugccccaaguauguaaaaucaacaaagcugcgccuugcuaccgggcugagaaacgugccuaguauucagagcaggggauuguuuggcgccauagcgggcuucaucgaagggggauggacugguauggucgacggcugguacggguaucaucaccagaaugaacaaggauccggcuacgccgcagaucucaaaucuacacagaacgcuauugacgagaucaccaauaaggugaacagcguuauagagaaaaugaauacgcaguuuaccgccguggguaaggaguucaaccaccuggaaaagcggauugaaaauuuaaacaaaaaggucgaugacggguuccuggauaucuggacauacaaugcugagcuccuugugcuguuggaaaacgagcgcacucuagacuaucaugauucaaauguaaagaaccuguacgagaagguucgaagucagcucaaaaacaaugccaaggaaaucggcaacggauguuuugaguucuaucacaagugcgacaauaccuguauggaauccgugaaaaacggcacauacgauuauccaaaguacagcgaggaagcaaaacugaauagagaggagauugacggggucaaacuugaaucuacuaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 125661 - RNA, 1701 nt, Artificial Sequence; identical to SEQ ID NO: 124672
  derived and/or modified sequence opt3 from hemagglutinin__InfluenzaA__ACZ16210

SEQ ID NO: 125662 - RNA, 1701 nt, Artificial Sequence; identical to SEQ ID NO: 124672
  derived and/or modified sequence opt3 from hemagglutinin__InfluenzaA__ACZ16220

SEQ ID NO: 125663 - RNA, 1701 nt, Artificial Sequence; identical to SEQ ID NO: 125420
  derived and/or modified sequence opt3 from hemagglutinin__InfluenzaA__ACZ16230

SEQ ID NO: 125664 - RNA, 1701 nt, Artificial Sequence
  derived and/or modified sequence opt3 from hemagglutinin__InfluenzaA__ACZ16240
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgcccucgacgagaucaccaauaaggugaacagcguuauagagaaaaugaauacgcaguuuaccgcuguggguaaggaguucaaccaccuggagaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacggggucaaacuugaaucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 125665 - RNA, 1701 nt, Artificial Sequence; identical to SEQ ID NO: 124672
  derived and/or modified sequence opt3 from hemagglutinin__InfluenzaA__ACZ16260

SEQ ID NO: 125666 - RNA, 1701 nt, Artificial Sequence
  derived and/or modified sequence opt3 from hemagglutinin__InfluenzaA__ACZ16270
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaacuuguaccagaaugccgacgcguacguguucgucgggaguucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugauccucgucgugagccugggagcaauuuccuuuuggaugugcucuaaugguucguuacagugccggaucuguaucuga

SEQ ID NO: 125667 - RNA, 1701 nt, Artificial Sequence; identical to SEQ ID NO: 125347
  derived and/or modified sequence opt3 from hemagglutinin__InfluenzaA__ACZ16280

SEQ ID NO: 125668 - RNA, 1701 nt, Artificial Sequence; identical to SEQ ID NO: 124672
  derived and/or modified sequence opt3 from hemagglutinin__InfluenzaA__ACZ16290

SEQ ID NO: 125669 - RNA, 1701 nt, Artificial Sequence
  derived and/or modified sequence opt3 from hemagglutinin__InfluenzaA__ACZ16300
augaaggccauccuggugguccuccuuuacaccuucgcuacagcaaacgccgacacucugugcauuggcuaucacgcgaauaacagcacggauaccguugacacaguguuggagaaaaauguaauagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggucuucccgcuauagcaagaaauuuaagccugagaucgcaauucgaccaaaagugcgugaucaggagggaagaaugaauuacuauuggacgcugguggaacccggugacaagaucacuuucgaggccaccggcaaccuacucgucccuagguacgcuuuugccauggaacggaacgcagggucgggaauaauuaucucugauacaccaguucaugacugcaauacuaccugucaaacaccgaaaggcgcuauuaacaccucccugcccuuccagaauauccacccuaucacgauugguaagugcccaaaguaugugaaaucaacuaaacuucgccuggccacaggguugagaaacguacccaguauacagagcaggggacucuuuggcgcgaucgccggcuucauugaagggggauggaccgguaugguggacggcugguacggguaucaucaccagaaugaacaaggauccggcuacgcagcugaucugaagucuacucagaacgccaucgacgagauaacaaauaaggucaacagcgugauugagaaaaugaauacccaguuuacggcuguugguaaggaguucaaccacuuagaaaagcggaucgaaaaucugaacaaaaagguggaugacggguuccucgauaucuggaccuacaaugccgagcuucuggucuugcuagaaaacgagcgcacacuggacuaucaugauucaaaugugaaaaaccucuacgagaagguacgaagucagcugaaaaacaaugcaaaggaaauuggcaacggauguuuugaguucuaucacaagugcgacaauacuuguauggaauccguuaaaaacggcaccuacgauuauccuaaguacagcgaggaagccaaacuuaauagagaggagaucgacggggugaagcuggaaucuacaaggauuuaucaaauauuggcuaucuacucaacugucgcgaguagccucgugcuggucguguccuuaggagcaauuucuuuuuggaugugcucgaacgguagccugcagugccggaucuguaucuga

SEQ ID NO: 125670 - RNA, 1701 nt, Artificial Sequence; identical to SEQ ID NO: 125415
  derived and/or modified sequence opt3 from hemagglutinin__InfluenzaA__ACZ16310

SEQ ID NO: 125671 - RNA, 1701 nt, Artificial Sequence
  derived and/or modified sequence opt3 from hemagglutinin__InfluenzaA__ACZ16320
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacacgccugagacuugccaccgggcugaggaacgugcccaguauucagagccggggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaagaguucaaccaccuggaaaagcgcauugaaaauuuaaacaagaaagucgaugacggguuccuggauaucuggacauacaaugccgagcuccuugugcuguuggaaaacgagcgaacucuagacuaucaugauucaaauguaaagaaccuguacgagaaaguuagaagucagcucaagaacaaugcaaaagaaaucggcaacggauguuuugaguucuaucacaagugcgacaauaccuguauggaauccgugaagaacggcacauacgauuauccuaaauacagcgaggaagccaagcugaauagggaggagauugacggggucaaacuugaaucuacucggaucuaucaaauucuggcuauauacucaaccguggcgaguagcuugguccucgugguuucccugggagcaaucucuuuuuggaugugcucgaacgguagcuuacagugccguauuuguaucuga

SEQ ID NO: 125672 - RNA, 1701 nt, Artificial Sequence; identical to SEQ ID NO: 125415
  derived and/or modified sequence opt3 from hemagglutinin__InfluenzaA__ACZ16330

SEQ ID NO: 125673 - RNA, 1701 nt, Artificial Sequence; identical to SEQ ID NO: 124865
  derived and/or modified sequence opt3 from hemagglutinin__InfluenzaA__ACZ16340

SEQ ID NO: 125674 - RNA, 1701 nt, Artificial Sequence; identical to SEQ ID NO: 124672
  derived and/or modified sequence opt3 from hemagglutinin__InfluenzaA__ACZ16350

SEQ ID NO: 125675 - RNA, 1701 nt, Artificial Sequence; identical to SEQ ID NO: 124672
  derived and/or modified sequence opt3 from hemagglutinin__InfluenzaA__ACZ16360

SEQ ID NO: 125676 - RNA, 1701 nt, Artificial Sequence; identical to SEQ ID NO: 124865
  derived and/or modified sequence opt3 from hemagglutinin__InfluenzaA__ACZ16370

SEQ ID NO: 125677 - RNA, 1701 nt, Artificial Sequence; identical to SEQ ID NO: 124672
  derived and/or modified sequence opt3 from hemagglutinin__InfluenzaA__ACZ16380

SEQ ID NO: 125678 - RNA, 1701 nt, Artificial Sequence; identical to SEQ ID NO: 124672
  derived and/or modified sequence opt3 from hemagglutinin__InfluenzaA__ACZ16390

SEQ ID NO: 125679 - RNA, 1701 nt, Artificial Sequence; identical to SEQ ID NO: 124672
  derived and/or modified sequence opt3 from hemagglutinin__InfluenzaA__ACZ16400

SEQ ID NO: 125680 - RNA, 1701 nt, Artificial Sequence; identical to SEQ ID NO: 124672
  derived and/or modified sequence opt3 from hemagglutinin__InfluenzaA__ACZ16410

SEQ ID NO: 125681 - RNA, 1701 nt, Artificial Sequence; identical to SEQ ID NO: 125309
  derived and/or modified sequence opt3 from hemagglutinin__InfluenzaA__ACZ16420

SEQ ID NO: 125682 - RNA, 1701 nt, Artificial Sequence; identical to SEQ ID NO: 124672
  derived and/or modified sequence opt3 from hemagglutinin__InfluenzaA__ACZ16430

SEQ ID NO: 125683 - RNA, 1701 nt, Artificial Sequence; identical to SEQ ID NO: 124672
  derived and/or modified sequence opt3 from hemagglutinin__InfluenzaA__ACZ16440

SEQ ID NO: 125684 - RNA, 1701 nt, Artificial Sequence
  derived and/or modified sequence opt3 from hemagglutinin__InfluenzaA__ACZ16450
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucuggugaagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccagaaugagcaaggauccggcuacgcagcugaucucaagucuacacagaacgccauugacgaaaucaccaauaaagugaacagcguuauagagaagaugaauacgcaguuuaccgcuguggguaaggaguucaaccaccuggaaaaacggauugagaauuuaaacaagaaagucgaugacggguuccuggauaucuggacauacaaugccgaacuccuugugcuguuggagaacgaacgcacucuagacuaucaugauucaaauguaaagaaccuguacgagaaaguucgaagucagcucaagaacaaugcaaaggagaucggcaacggauguuuugaguucuaucacaaaugcgacaauaccuguauggaguccgugaagaacggcacauacgauuauccuaaauacagcgaagaggccaagcugaauagagaagagauugacggggucaaacuugagucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 125685 - RNA, 1701 nt, Artificial Sequence; identical to SEQ ID NO: 124865
  derived and/or modified sequence opt3 from hemagglutinin__InfluenzaA__ACZ16460

SEQ ID NO: 125686 - RNA, 1701 nt, Artificial Sequence; identical to SEQ ID NO: 124672
  derived and/or modified sequence opt3 from hemagglutinin__InfluenzaA__ACZ16470

SEQ ID NO: 125687 - RNA, 1701 nt, Artificial Sequence; identical to SEQ ID NO: 124672
  derived and/or modified sequence opt3 from hemagglutinin__InfluenzaA__ACZ16480

SEQ ID NO: 125688 - RNA, 1701 nt, Artificial Sequence; identical to SEQ ID NO: 125420
  derived and/or modified sequence opt3 from hemagglutinin__InfluenzaA__ACZ16490

SEQ ID NO: 125689 - RNA, 1701 nt, Artificial Sequence; identical to SEQ ID NO: 124672
  derived and/or modified sequence opt3 from hemagglutinin__InfluenzaA__ACZ16500

SEQ ID NO: 125690 - RNA, 1701 nt, Artificial Sequence; identical to SEQ ID NO: 124865
  derived and/or modified sequence opt3 from hemagglutinin__InfluenzaA__ACZ16510

SEQ ID NO: 125691 - RNA, 1701 nt, Artificial Sequence; identical to SEQ ID NO: 124672
  derived and/or modified sequence opt3 from hemagglutinin__InfluenzaA__ACZ16530

SEQ ID NO: 125692 - RNA, 1701 nt, Artificial Sequence
  derived and/or modified sequence opt3 from hemagglutinin__InfluenzaA__ACZ16540
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguugggcgcgaucgccggcuuuauugaagggggauggacugguauggucgacggcugguacggguaucaucaccagaaugagcaaggauccggcuacgcagcugaucucaaaucuacacagaacgccaucgacgagauaaccaauaaggugaacagcguuauugagaaaaugaauacgcaguucaccgcuguggguaaggaauuuaaccaccuggagaagcggaucgaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaauuggcaacggauguuucgaguuuuaucacaagugcgacaauaccuguauggaauccgugaaaaacggcacauacgauuauccuaaguacagcgaggaagccaaacugaauagagaggagaucgacggggucaaacuugaaucuacuaggauuuaucaaauacuggcuaucuacucaaccguggcgaguagcuugguccucgugguuucccugggagcaauuucuuucuggaugugcucgaacgguagcuuacagugccggaucuguaucuga

SEQ ID NO: 125693 - RNA, 1701 nt, Artificial Sequence; identical to SEQ ID NO: 125415
  derived and/or modified sequence opt3 from hemagglutinin__InfluenzaA__ACZ16550

SEQ ID NO: 125694 - RNA, 1701 nt, Artificial Sequence; identical to SEQ ID NO: 124672
  derived and/or modified sequence opt3 from hemagglutinin__InfluenzaA__ACZ16583

SEQ ID NO: 125695 - RNA, 1701 nt, Artificial Sequence; identical to SEQ ID NO: 125415
  derived and/or modified sequence opt3 from hemagglutinin__InfluenzaA__ACZ16593

SEQ ID NO: 125696 - RNA, 1701 nt, Artificial Sequence; identical to SEQ ID NO: 124672
  derived and/or modified sequence opt3 from hemagglutinin__InfluenzaA__ACZ16603

SEQ ID NO: 125697 - RNA, 1701 nt, Artificial Sequence; identical to SEQ ID NO: 125415
  derived and/or modified sequence opt3 from hemagglutinin__InfluenzaA__ACZ16630

SEQ ID NO: 125698 - RNA, 1701 nt, Artificial Sequence; identical to SEQ ID NO: 124672
  derived and/or modified sequence opt3 from hemagglutinin__InfluenzaA__ACZ16640

SEQ ID NO: 125699 - RNA, 1701 nt, Artificial Sequence; identical to SEQ ID NO: 124672
  derived and/or modified sequence opt3 from hemagglutinin__InfluenzaA__ACZ16650

SEQ ID NO: 125700 - RNA, 1701 nt, Artificial Sequence; identical to SEQ ID NO: 124672
  derived and/or modified sequence opt3 from hemagglutinin__InfluenzaA__ACZ16660

SEQ ID NO: 125701 - RNA, 1701 nt, Artificial Sequence; identical to SEQ ID NO: 124672
  derived and/or modified sequence opt3 from hemagglutinin__InfluenzaA__ACZ16670

SEQ ID NO: 125702 - RNA, 1701 nt, Artificial Sequence; identical to SEQ ID NO: 124672
  derived and/or modified sequence opt3 from hemagglutinin__InfluenzaA__ACZ16680

SEQ ID NO: 125703 - RNA, 1701 nt, Artificial Sequence; identical to SEQ ID NO: 124672
  derived and/or modified sequence opt3 from hemagglutinin__InfluenzaA__ACZ16690

SEQ ID NO: 125704 - RNA, 1701 nt, Artificial Sequence; identical to SEQ ID NO: 124672
  derived and/or modified sequence opt3 from hemagglutinin__InfluenzaA__ACZ16700

SEQ ID NO: 125705 - RNA, 1701 nt, Artificial Sequence; identical to SEQ ID NO: 124672
  derived and/or modified sequence opt3 from hemagglutinin__InfluenzaA__ACZ16710

SEQ ID NO: 125706 - RNA, 1701 nt, Artificial Sequence; identical to SEQ ID NO: 124672
  derived and/or modified sequence opt3 from hemagglutinin__InfluenzaA__ACZ16720

SEQ ID NO: 125707 - RNA, 1701 nt, Artificial Sequence; identical to SEQ ID NO: 125415
  derived and/or modified sequence opt3 from hemagglutinin__InfluenzaA__ACZ16730

SEQ ID NO: 125708 - RNA, 1701 nt, Artificial Sequence; identical to SEQ ID NO: 125415
  derived and/or modified sequence opt3 from hemagglutinin__InfluenzaA__ACZ16740

SEQ ID NO: 125709 - RNA, 1701 nt, Artificial Sequence; identical to SEQ ID NO: 124672
  derived and/or modified sequence opt3 from hemagglutinin__InfluenzaA__ACZ16750

SEQ ID NO: 125710 - RNA, 1701 nt, Artificial Sequence; identical to SEQ ID NO: 124672
  derived and/or modified sequence opt3 from hemagglutinin__InfluenzaA__ACZ16760

SEQ ID NO: 125711 - RNA, 1701 nt, Artificial Sequence; identical to SEQ ID NO: 124865
  derived and/or modified sequence opt3 from hemagglutinin__InfluenzaA__ACZ16770

SEQ ID NO: 125712 - RNA, 1701 nt, Artificial Sequence; identical to SEQ ID NO: 124672
  derived and/or modified sequence opt3 from hemagglutinin__InfluenzaA__ACZ16780

SEQ ID NO: 125713 - RNA, 1701 nt, Artificial Sequence; identical to SEQ ID NO: 124672
  derived and/or modified sequence opt3 from hemagglutinin__InfluenzaA__ACZ16790

SEQ ID NO: 125714 - RNA, 1701 nt, Artificial Sequence; identical to SEQ ID NO: 124672
  derived and/or modified sequence opt3 from hemagglutinin__InfluenzaA__ACZ16800

SEQ ID NO: 125715 - RNA, 1701 nt, Artificial Sequence; identical to SEQ ID NO: 124672
  derived and/or modified sequence opt3 from hemagglutinin__InfluenzaA__ACZ16810

SEQ ID NO: 125716 - RNA, 1701 nt, Artificial Sequence; identical to SEQ ID NO: 125347
  derived and/or modified sequence opt3 from hemagglutinin__InfluenzaA__ACZ16820

SEQ ID NO: 125717 - RNA, 1701 nt, Artificial Sequence; identical to SEQ ID NO: 124672
  derived and/or modified sequence opt3 from hemagglutinin__InfluenzaA__ACZ16830

SEQ ID NO: 125718 - RNA, 1701 nt, Artificial Sequence
  derived and/or modified sequence opt3 from hemagglutinin__InfluenzaA__ACZ16840
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaacuaaagugcgugaucaggagggaagaaugaauuacuauuggacccugguggaaccaggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 125719 - RNA, 1701 nt, Artificial Sequence; identical to SEQ ID NO: 124672
  derived and/or modified sequence opt3 from hemagglutinin__InfluenzaA__ACZ16850

SEQ ID NO: 125720 - RNA, 1701 nt, Artificial Sequence
  derived and/or modified sequence opt3 from hemagglutinin__InfluenzaA__ACZ16860
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucgcuccuagguacgccuuugcaauggaacggaacgcugggucgggaaucauaauuucugauacuccaguucaugacugcaauaccacaugucaaaccccgaaaggcgccaucaacacgucccuccccuuccagaauauucacccuaucacuaucgguaagugcccaaaguaugugaaaucaacaaagcugcgccuugcgaccgggcugagaaacguacccaguauucagagcaggggauuguuuggcgccauagcaggcuucaucgaagggggauggacugguaugguggacggcugguacggguaucaucaccagaaugaacaaggauccggcuacgcugccgaucucaaaucuacacagaacgcuauugacgagaucaccaauaaggucaacagcgugauagagaaaaugaauacgcaguuuaccgccguugguaaggaguucaaccaccuggaaaagcggauugaaaauuuaaacaaaaagguggaugacggguuccuggauaucuggacauacaaugcagagcuccuuguccuguuggaaaacgagcgcacucuagacuaucaugauucaaaugugaaaaaccuguacgagaagguacgaagucagcucaaaaacaaugccaaggaaaucggcaacggauguuuugaguucuaucacaagugcgacaauaccuguauggaauccguuaaaaacggcacauacgauuauccuaaguacagcgaggaagcuaaacugaauagagaggagauugacggggugaaacuugaaucuacuaggaucuaucaaauucuggcgauauacucaaccgucgcaaguagcuuggugcucgucgugucccugggagccaucucuuuuuggaugugcucgaacgguagcuuacagugccggauuuguaucuga

SEQ ID NO: 125721 - RNA, 1701 nt, Artificial Sequence; identical to SEQ ID NO: 125415
  derived and/or modified sequence opt3 from hemagglutinin__InfluenzaA__ACZ16870

SEQ ID NO: 125722 - RNA, 1701 nt, Artificial Sequence
  derived and/or modified sequence opt3 from hemagglutinin__InfluenzaA__ACZ16880
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgaugggucgggaaucauaauuucugacacuccagugcaugacugcaauaccacaugucaaaccccgaaaggcgcaaucaacacgucccuccccuuccagaauauucacccuaucacuaucgguaagugcccaaaguauguaaaaucaacaaagcugcgccuugcuaccgggcugagaaacgugcccaguauucagagcaggggauuguuuggcgccauagcgggcuucaucgaagggggauggacugguauggucgauggcugguacggguaucaucaccagaaugaacaaggauccggcuacgccgcagaccucaaaucuacacagaacgcuauugaugagaucaccaauaaggugaacagcguuauagagaaaaugaauacgcaguuuaccgccguggguaaggaguucaaccaccuggaaaagcggauugaaaauuuaaacaaaaaggucgacgauggguuccuggacaucuggacauacaaugcugagcuccuugugcuguuggaaaacgagcgcacucuagauuaucaugacucaaauguaaagaaccuguacgagaagguucgaagucagcucaaaaacaaugccaaggaaaucggcaacggauguuuugaguucuaucacaagugcaauaacaccuguauggaauccgugaaaaauggcacauacgauuauccuaaguacagcgaggaagcaaaacugaacagagaggagauugacggggucaaacuugaaucuacuaggaucuaucaaauucuggccauauacucaaccguggcuaguagcuugguccucgugguuucccugggagcgaucucuuuuuggaugugcucgaaugguagcuuacagugccggauuuguaucuga

SEQ ID NO: 125723 - RNA, 1701 nt, Artificial Sequence; identical to SEQ ID NO: 125420
  derived and/or modified sequence opt3 from hemagglutinin__InfluenzaA__ACZ16890

SEQ ID NO: 125724 - RNA, 1701 nt, Artificial Sequence; identical to SEQ ID NO: 124672
  derived and/or modified sequence opt3 from hemagglutinin__InfluenzaA__ACZ16900

SEQ ID NO: 125725 - RNA, 1701 nt, Artificial Sequence; identical to SEQ ID NO: 124672
  derived and/or modified sequence opt3 from hemagglutinin__InfluenzaA__ACZ16910

SEQ ID NO: 125726 - RNA, 1701 nt, Artificial Sequence; identical to SEQ ID NO: 124672
  derived and/or modified sequence opt3 from hemagglutinin__InfluenzaA__ACZ16920

SEQ ID NO: 125727 - RNA, 1701 nt, Artificial Sequence; identical to SEQ ID NO: 124685
  derived and/or modified sequence opt3 from hemagglutinin__InfluenzaA__ACZ16930

SEQ ID NO: 125728 - RNA, 1701 nt, Artificial Sequence; identical to SEQ ID NO: 124685
  derived and/or modified sequence opt3 from hemagglutinin__InfluenzaA__ACZ16940

SEQ ID NO: 125729 - RNA, 1701 nt, Artificial Sequence; identical to SEQ ID NO: 124672
  derived and/or modified sequence opt3 from hemagglutinin__InfluenzaA__ACZ16950

SEQ ID NO: 125730 - RNA, 1701 nt, Artificial Sequence; identical to SEQ ID NO: 124927
  derived and/or modified sequence opt3 from hemagglutinin__InfluenzaA__ACZ16960

SEQ ID NO: 125731 - RNA, 1701 nt, Artificial Sequence
  derived and/or modified sequence opt3 from hemagglutinin__InfluenzaA__ACZ16970
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaagaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125732 - RNA, 1701 nt, Artificial Sequence; identical to SEQ ID NO: 124685
  derived and/or modified sequence opt3 from hemagglutinin__InfluenzaA__ACZ16980

SEQ ID NO: 125733 - RNA, 1701 nt, Artificial Sequence; identical to SEQ ID NO: 124685
  derived and/or modified sequence opt3 from hemagglutinin__InfluenzaA__ACZ17000

SEQ ID NO: 125734 - RNA, 1701 nt, Artificial Sequence
  derived and/or modified sequence opt3 from hemagglutinin__InfluenzaA__ACZ17010
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacaaaaucaccaauaaggugaacagcguuauagagaagaugaauacgcaguuuaccgcuguggguaaagaguucaaccaccuggaaaagaggauugagaauuuaaacaaaaaggucgaugacggguuccuggauaucuggacauacaaugccgaacuccuugugcuguuggagaacgaacggacucuagacuaucaugauucaaauguaaagaaccuguacgagaagguucgcagucagcucaagaacaaugcaaaagagaucggcaacggauguuuugaguucuaucacaagugcgacaauaccuguauggaauccgugaaaaacggcacauacgauuauccuaaguacagcgaagaggccaaacugaaucgagaagagauugacggggucaaacuugagucuacuagaaucuaucaaauucuggcuauauacucaaccguggcgaguagcuugguccucgugguuucccugggagcaaucucuuuuuggaugugcucgaacgguagcuuacagugcaggauuuguaucuga

SEQ ID NO: 125735 - RNA, 1701 nt, Artificial Sequence; identical to SEQ ID NO: 124685
  derived and/or modified sequence opt3 from hemagglutinin__InfluenzaA__ACZ17020

SEQ ID NO: 125736 - RNA, 1701 nt, Artificial Sequence
  derived and/or modified sequence opt3 from hemagglutinin__InfluenzaA__ACZ17030
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugaggccucuucgucagacaacggaacuugcuauccaggcgauuuuauugacuacgaggagcucagggagcagcugagcaguguguccucuuucgaacgguuugagaucuucccgaagacaagcuccuggcccaaucacgauucaaacaagggugucaccgcugcauguccucaugccggggcuaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgccgaucaacagaguuuguaccagaacgcggacgcauacguguucgucgggacuucucgcuauuccaagaaauuuaagccugagaucgccauucgaccaaaagugcgugaucaggagggaagaaugaauuacuauuggacccugguggaacccggugacaagaucacauucgaggcuacuggcaaccuagucguuccuagguacgccuuugcaauggaacggaacgcugggagcggaauuaucauaucggauaccccagugcaugacugcaauacaaccugucaaacgccgaaaggcgccauuaacacuucucuccccuuccagaauauccacccuauuacaaucgguaagugcccaaaguauguaaaauccaccaagcugcgccuugcgacugggcugagaaacgugcccucaauccagaguaggggauuguuuggcgccauugcaggcuucauagaagggggauggacagguauggucgacggcugguacggguaucaucaccagaaugaacaaggaagcggcuacgcugccgaucucaaauccacccagaacgcuaucgacgagauuacgaauaaggugaacucuguuaucgagaaaaugaauacccaguuuacagccguggguaaggaguucaaccaccuggaaaagcggauagaaaauuuaaacaaaaaggucgaugacggguuccuggauauuuggacuuacaaugcagagcuccuugugcuguuggaaaacgagcgcacccuagacuaucaugauagcaauguaaagaaccuguacgagaagguucgaucacagcucaaaaacaaugccaaggaaaucggcaacggauguuuugaguucuaucacaagugcgacaauacauguauggaaagugugaaaaacggcacuuacgauuauccuaaguacuccgaggaagcuaaacugaauagagaggagaucgacggggucaaacuugaaagcaccaggauuuaucaaauccuggcgauuuacucuacaguggcaucaaguuugguccucgugguuagccugggagccauauccuuuuggaugugcucuaacgguucguuacagugccggaucuguauuuga

SEQ ID NO: 125737 - RNA, 1701 nt, Artificial Sequence
  derived and/or modified sequence opt3 from hemagglutinin__InfluenzaA__ACZ17040
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacagcucaaaaacaaugcaaaggaaaucggcaacggauguuuugaguucuaucacaagugcgacaauacauguauggaaagugugaaaaacggcacuuacgauuauccuaaguacuccaaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125738 - RNA, 1701 nt, Artificial Sequence; identical to SEQ ID NO: 124685
  derived and/or modified sequence opt3 from hemagglutinin__InfluenzaA__ACZ17050

SEQ ID NO: 125739 - RNA, 1701 nt, Artificial Sequence; identical to SEQ ID NO: 124685
  derived and/or modified sequence opt3 from hemagglutinin__InfluenzaA__ACZ17060

SEQ ID NO: 125740 - RNA, 1701 nt, Artificial Sequence; identical to SEQ ID NO: 124685
  derived and/or modified sequence opt3 from hemagglutinin__InfluenzaA__ACZ17070

SEQ ID NO: 125741 - RNA, 1701 nt, Artificial Sequence; identical to SEQ ID NO: 124865
  derived and/or modified sequence opt3 from hemagglutinin__InfluenzaA__ACZ17080

SEQ ID NO: 125742 - RNA, 1701 nt, Artificial Sequence
  derived and/or modified sequence opt3 from hemagglutinin__InfluenzaA__ACZ17090
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacugggggauaagcacaauggaaaacuauguaagcucagagguguggcuccccugcaucuuggcaaaugcaacauagccggguggauccugggaaauccugaaugugagucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagaacgccgacgcguacguguucgucggaacuucucgcuauuccaagaaauuuaagccugaaauugcaauccgaccaaaagugcgugaucaggaggguagaaugaauuacuauuggacccugguggagcccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacgaaaucacgaauaaggugaacucuguuauagagaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauagcaauguuaaaaaccuguacgagaagguaaaaucacagcucaagaacaaugcaaaggagaucggaaacggcuguuuugaguucuaucacaaaugcgacaauacauguauggaaagugugaagaacgggacuuacgauuauccuaaauacuccgaagaggccaagcugaaucgagaagagauugacggagucaaacuugagagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 125743 - RNA, 1701 nt, Artificial Sequence; identical to SEQ ID NO: 124672
  derived and/or modified sequence opt3 from hemagglutinin__InfluenzaA__ACZ17100

SEQ ID NO: 125744 - RNA, 1701 nt, Artificial Sequence
  derived and/or modified sequence opt3 from hemagglutinin__InfluenzaA__ACZ17110
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccagaauuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125745 - RNA, 1701 nt, Artificial Sequence
  derived and/or modified sequence opt3 from hemagglutinin__InfluenzaA__ACZ17120
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaacaaacgcaaaggaaaucggcaauggauguuuugaguucuaucacaagugcgacaacacuuguauggaaagugugaaaaauggcaccuacgauuauccuaaguacuccgaggaagccaaacugaacagagaggagauugacggggucaaacuugaaagcacaaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 125746 - RNA, 1701 nt, Artificial Sequence
  derived and/or modified sequence opt3 from hemagglutinin__InfluenzaA__ACZ17130
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaaugcucaguuuaccgccguggguaaggaguucaaccaccuggaaaagcggauugaaaauuuaaacaaaaaggucgaugacggguuccuggauaucuggacauacaaugcagagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagagaggagauugacggggucaaacuugaaagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 125747 - RNA, 1701 nt, Artificial Sequence; identical to SEQ ID NO: 125483
  derived and/or modified sequence opt3 from hemagglutinin__InfluenzaA__ACZ17140

SEQ ID NO: 125748 - RNA, 1701 nt, Artificial Sequence; identical to SEQ ID NO: 125314
  derived and/or modified sequence opt3 from hemagglutinin__InfluenzaA__ACZ17150

SEQ ID NO: 125749 - RNA, 1701 nt, Artificial Sequence; identical to SEQ ID NO: 125314
  derived and/or modified sequence opt3 from hemagglutinin__InfluenzaA__ACZ17160

SEQ ID NO: 125750 - RNA, 1701 nt, Artificial Sequence; identical to SEQ ID NO: 125314
  derived and/or modified sequence opt3 from hemagglutinin__InfluenzaA__ACZ17170

SEQ ID NO: 125751 - RNA, 1701 nt, Artificial Sequence
  derived and/or modified sequence opt3 from hemagglutinin__InfluenzaA__ACZ17190
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcucuacaaccugucaaacgccggagggcgcuaucaauacuucccuccccuuccagaacauucacccuaucacaaucgguaaaugcccaaaguauguaaagucaaccaaacugcgccuugccacugggcugagaaaugugcccaguauucagagcaggggauuguuuggcgcgauagccggcuucaucgaagggggauggacagguauggucgacggcugguacggguaucaucaccagaacgagcaaggauccggcuacgcagcugaucucaagucuacccagaaugccauugacgagaucacgaacaaagugaauagcguuauagaaaagaugaacacccaguuuacagcuguggguaaagaguucaaucaccuggaaaagcggauugagaacuuaaauaagaaagucgaugacggguuccuggauaucuggacuuacaacgccgaacuccuugugcuguuggagaaugagcgcacccuagacuaucaugauucaaacguaaagaaucuguacgaaaaaguucgaagucagcucaagaacaacgcaaaagagaucggcaauggauguuuugaguucuaucacaagugcgacaacacauguauggaguccgugaagaauggcacuuacgauuauccuaaauacagcgaagaggccaagcugaacagagaggaaauugacggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 125752 - RNA, 1701 nt, Artificial Sequence; identical to SEQ ID NO: 125751
  derived and/or modified sequence opt3 from hemagglutinin__InfluenzaA__ACZ17200

SEQ ID NO: 125753 - RNA, 1701 nt, Artificial Sequence; identical to SEQ ID NO: 124685
  derived and/or modified sequence opt3 from hemagglutinin__InfluenzaA__ACZ17220

SEQ ID NO: 125754 - RNA, 1701 nt, Artificial Sequence
  derived and/or modified sequence opt3 from hemagglutinin__InfluenzaA__ACZ17230
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucaaggagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuucgaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 125755 - RNA, 1701 nt, Artificial Sequence; identical to SEQ ID NO: 124685
  derived and/or modified sequence opt3 from hemagglutinin__InfluenzaA__ACZ17240

SEQ ID NO: 125756 - RNA, 1701 nt, Artificial Sequence; identical to SEQ ID NO: 124685
  derived and/or modified sequence opt3 from hemagglutinin__InfluenzaA__ACZ17250

SEQ ID NO: 125757 - RNA, 1701 nt, Artificial Sequence; identical to SEQ ID NO: 124685
  derived and/or modified sequence opt3 from hemagglutinin__InfluenzaA__ACZ17260

SEQ ID NO: 125758 - RNA, 1701 nt, Artificial Sequence
  derived and/or modified sequence opt3 from hemagglutinin__InfluenzaA__ACZ17270
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaggugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaacuguacgagaagguuagaucacagcucaaaaacaacgcaaaggaaaucggcaauggauguuuugaguucuaucacaagugcgacaacacauguauggaaagugugaaaaauggcacuuacgauuauccuaaguacuccgaggaagccaaacugaacagggaggagauugacggggucaaacuugaaagcacccggguguaucaaauccuggcuauuuacucuacagucgcgucaaguuuggugcucguugugagccugggagcaauauccuuuuggaugugcucuaaugguucguuacagugccguaucuguauuuga

SEQ ID NO: 125759 - RNA, 1701 nt, Artificial Sequence; identical to SEQ ID NO: 124865
  derived and/or modified sequence opt3 from hemagglutinin__InfluenzaA__ACZ17290

SEQ ID NO: 125760 - RNA, 1701 nt, Artificial Sequence; identical to SEQ ID NO: 124865
  derived and/or modified sequence opt3 from hemagglutinin__InfluenzaA__ACZ17300

SEQ ID NO: 125761 - RNA, 1701 nt, Artificial Sequence; identical to SEQ ID NO: 124865
  derived and/or modified sequence opt3 from hemagglutinin__InfluenzaA__ACZ17310

SEQ ID NO: 125762 - RNA, 1701 nt, Artificial Sequence; identical to SEQ ID NO: 124685
  derived and/or modified sequence opt3 from hemagglutinin__InfluenzaA__ACZ17398

SEQ ID NO: 125763 - RNA, 1701 nt, Artificial Sequence; identical to SEQ ID NO: 124685
  derived and/or modified sequence opt3 from hemagglutinin__InfluenzaA__ACZ17408

SEQ ID NO: 125764 - RNA, 1701 nt, Artificial Sequence; identical to SEQ ID NO: 124685
  derived and/or modified sequence opt3 from hemagglutinin__InfluenzaA__ACZ17418

SEQ ID NO: 125765 - RNA, 1701 nt, Artificial Sequence
  derived and/or modified sequence opt3 from hemagglutinin__InfluenzaA__ACZ17438
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucggguccagccgcuauucgaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccgggucuggaaucauaauuuccgauacuccagugcaugacugcaauaccacaugucaaaccccgaaaggcgcaaucaacacgucacuccccuuccagaauauucacccuaucacuaucgguaagugcccaaaguauguaaaaaguacaaagcugcgccuugcuaccgggcugagaaacgugcccagcauucaguccaggggauuguuuggcgccauagcgggcuucaucgaagggggauggacugguauggucgacggcugguacggguaucaucaccagaaugaacaaggaucuggcuacgccgcagaucucaaaagcacacagaacgcuauugacgagaucaccaauaaggugaacucaguuauagagaaaaugaauacgcaguuuaccgccguggguaaggaguucaaccaccuggaaaagcggauugaaaauuuaaacaaaaaggucgaugacggguuccuggauaucuggacauacaaugcugagcuccuugugcuguuggaaaacgagcgcacucuagacuaucaugauaguaauguaaagaaccuguacgagaagguucgaucccagcucaaaaacaaugccaaggaaaucggcaacggauguuuugaguucuaucacaagugcgacaauaccuguauggaaagcgugaaaaacggcacauacgauuauccuaaguacucugaggaagcaaaacugaauagagaggagauugacggggucaaacuugaaucaacuaggaucuaucaaauucuggccauauacaguaccguggcuagcuccuugguccucgugguuucucugggagcgaucucguuuuggaugugcagcaacgguuccuuacagugccggauuuguaucuga

SEQ ID NO: 125766 - RNA, 1701 nt, Artificial Sequence; identical to SEQ ID NO: 124672
  derived and/or modified sequence opt3 from hemagglutinin__InfluenzaA__ACZ17448

SEQ ID NO: 125767 - RNA, 1701 nt, Artificial Sequence; identical to SEQ ID NO: 124685
  derived and/or modified sequence opt3 from hemagglutinin__InfluenzaA__ACZ17458

SEQ ID NO: 125768 - RNA, 1701 nt, Artificial Sequence; identical to SEQ ID NO: 124672
  derived and/or modified sequence opt3 from hemagglutinin__InfluenzaA__ACZ17478

SEQ ID NO: 125769 - RNA, 1701 nt, Artificial Sequence; identical to SEQ ID NO: 124685
  derived and/or modified sequence opt3 from hemagglutinin__InfluenzaA__ACZ17488

SEQ ID NO: 125770 - RNA, 1701 nt, Artificial Sequence
  derived and/or modified sequence opt3 from hemagglutinin__InfluenzaA__ACZ18240
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauccuaacaagggugucacggcagccuguccacaugcuggggcaaaaucauuuuauaagaaucugaucuggcucgugaaaaagggaaacaguuaccccaaauuaagcaagucuuauauaaaugacaagggcaaagaaguacugguucuuuggggcauccaccacccuuccacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcaugacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgagaucaccaauaaggugaacuccguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauucuaauguaaagaaccuguacgagaagguucgaagccagcucaaaaacaaugccaaggaaaucggcaacggauguuuugaguucuaucacaagugcgacaauacuuguauggaaucagugaaaaacggcaccuacgauuauccaaaguacagugaggaagcaaaacugaauagagaggagauugacggggucaaacuugaauccacaaggaucuaucaaauucuggccauauacagcaccguggcuucuucauugguccucgugguuagucugggagcgaucagcuuuuggaugugcuccaacgguucuuuacagugccggauuuguaucuga

SEQ ID NO: 125771 - RNA, 1701 nt, Artificial Sequence; identical to SEQ ID NO: 124685
  derived and/or modified sequence opt3 from hemagglutinin__InfluenzaA__ACZ18241

SEQ ID NO: 125772 - RNA, 1701 nt, Artificial Sequence
  derived and/or modified sequence opt3 from hemagglutinin__InfluenzaA__ACZ27800
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaaggaguuuaaaccugagauugcaauccgaccaaaggugcguggacaggaagguagaaugaauuacuauuggacucugguggagcccggcgauaaaauuaccuucgaagccacagggaaccuagucguuccuagguacgcuuuugccauggagcggaacgcaggaucgggcaucauaauuucugacacuccagugcaugauugcaauaccacaugucaaaccccgaagggugcuaucaacacgucccuccccuuccagaauauucacccuaucacuaucgggaaaugcccaaaguauguaaagucaacaaaacugcgccuugccaccggacugagaaacgugcccaguauucagagcaggggcuuguuuggcgcgauagccggguucaucgaaggagguuggacuggcauggucgacgggugguacggauaucaucaccagaaugagcaaggcuccgguuacgcagcugaccucaagucuacacagaacgccauugaugagaucaccaauaaagugaacagcguuauagaaaagaugaauacgcaguuuaccgcuguggggaaagaguucaaccaccuggaaaagcggauugagaauuuaaacaagaaagucgacgauggcuuccuggacaucuggacauacaaugccgaacuccuugugcuguuggagaacgagcgcacucuagauuaucaugacucaaauguaaagaaccuguacgaaaaaguucgaagucagcucaagaacaaugcaaaagagaucggaaacggcuguuuugaguucuaucacaagugcgauaauaccuguauggaguccgugaagaacgggacauacgacuauccuaaauacagcgaagaggccaagcugaauagagaggaaauugauggagucaaacuugagucuacuaggaucuaucaaauucuggcuauauacucaaccguggcgaguagcuugguccucgugguuucccugggugcaaucucuuuuuggaugugcucgaacggcagcuuacagugccggauuuguaucuga

SEQ ID NO: 125773 - RNA, 1701 nt, Artificial Sequence; identical to SEQ ID NO: 124685
  derived and/or modified sequence opt3 from hemagglutinin__InfluenzaA__ACZ27810

SEQ ID NO: 125774 - RNA, 1701 nt, Artificial Sequence; identical to SEQ ID NO: 124685
  derived and/or modified sequence opt3 from hemagglutinin__InfluenzaA__ACZ27820

SEQ ID NO: 125775 - RNA, 1701 nt, Artificial Sequence; identical to SEQ ID NO: 124685
  derived and/or modified sequence opt3 from hemagglutinin__InfluenzaA__ACZ27830

SEQ ID NO: 125776 - RNA, 1701 nt, Artificial Sequence; identical to SEQ ID NO: 125038
  derived and/or modified sequence opt3 from hemagglutinin__InfluenzaA__ACZ27840

SEQ ID NO: 125777 - RNA, 1701 nt, Artificial Sequence; identical to SEQ ID NO: 124672
  derived and/or modified sequence opt3 from hemagglutinin__InfluenzaA__ACZ45006

SEQ ID NO: 125778 - RNA, 1701 nt, Artificial Sequence
  derived and/or modified sequence opt3 from hemagglutinin__InfluenzaA__ACZ45007
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcgaugcagcugaccucaaauccacccagaacgccauugaugagaucacgaauaaggugaacucuguuauagagaaaaugaauacccaguuuacagcuguggguaaggaguucaaccaccuggaaaagcggauugaaaauuuaaacaaaaaggucgacgauggguuccuggacaucuggacuuacaaugccgagcuccuugugcuguuggaaaacgagcgcacccuagauuaccaugacagcaauguaaagaaccuguaugagaagguucgaucacagcucaaaaacaaugcaaaggaaaucggcaacggauguuuugaguucuaccacaagugcgauaauacauguauggaaagugugaaaaacggcacuuaugacuacccuaaguauuccgaggaagccaaacugaauagagaggagauugauggggucaaacuugaaagcaccaggaucuaccaaauucuggcuauauauucuacaguggcgucaaguuugguccucgugguuagccugggagcaaucuccuuuuggaugugcucuaacgguucguuacagugccggauuuguaucuga

SEQ ID NO: 125779 - RNA, 1701 nt, Artificial Sequence; identical to SEQ ID NO: 125038
  derived and/or modified sequence opt3 from hemagglutinin__InfluenzaA__ACZ45008

SEQ ID NO: 125780 - RNA, 1701 nt, Artificial Sequence; identical to SEQ ID NO: 125038
  derived and/or modified sequence opt3 from hemagglutinin__InfluenzaA__ACZ45009

SEQ ID NO: 125781 - RNA, 1701 nt, Artificial Sequence; identical to SEQ ID NO: 124927
  derived and/or modified sequence opt3 from hemagglutinin__InfluenzaA__ACZ45010

SEQ ID NO: 125782 - RNA, 1701 nt, Artificial Sequence; identical to SEQ ID NO: 124685
  derived and/or modified sequence opt3 from hemagglutinin__InfluenzaA__ACZ45012

SEQ ID NO: 125783 - RNA, 1701 nt, Artificial Sequence
  derived and/or modified sequence opt3 from hemagglutinin__InfluenzaA__ACZ45013
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaguaagggugucaccgccgcuuguccucaugcaggggccaagagcuuuuauaagaaccugaucuggcucgugaaaaagggaaauucuuacccaaaauuauccaagucauauauaaacgacaagggcaaagaaguacugguucuuuggggcauccaccaccccagcacgagugcugaucaacagucuuuguaccagaaugccgacgcguacguguucgucgggacuucccgcuauagcaagaaauuuaagccugagauugcaauccgaccaaaagugcgugagcaggaaggaagaaugaacuacuauuggacccugguggagcccggugauaagauuacauucgaagccacuggcaaucuagucguuccuagguacgcuuuugccauggagcggaacgcagggucgggaaucauaauuucugacaccccagugcaugauugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgagcaaggauccggcuacgcagcugaccucaaaucuacccagaaugccauugaugagaucacgaacaaggugaauagcguuauagagaaaaugaacacccaguuuacagcuguggguaaggaguucaaucaccuggaaaagcggauugagaacuuaaauaaaaaggucgacgauggguuccuggacaucuggacuuacaacgccgaacuccuugugcuguuggagaaugagcgcacccuagauuaucaugacucaaacguuaaaaaucuguacgaaaagguacgaagucagcucaaaaacaacgcaaaggagaucggcaauggauguuuugaguucuaucacaagugcgauaacacauguauggaauccgugaaaaauggcacuuacgacuauccuaaguacagcgaagaggccaaacugaacagagaggaaauugauggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 125784 - RNA, 1701 nt, Artificial Sequence; identical to SEQ ID NO: 124685
  derived and/or modified sequence opt3 from hemagglutinin__InfluenzaA__ACZ45014

SEQ ID NO: 125785 - RNA, 1701 nt, Artificial Sequence; identical to SEQ ID NO: 124685
  derived and/or modified sequence opt3 from hemagglutinin__InfluenzaA__ACZ45016

SEQ ID NO: 125786 - RNA, 1701 nt, Artificial Sequence
  derived and/or modified sequence opt3 from hemagglutinin__InfluenzaA__ACZ45028
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 125787 - RNA, 1701 nt, Artificial Sequence
  derived and/or modified sequence opt3 from hemagglutinin__InfluenzaA__ACZ45029
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugauggagucaaacuugaaagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 125788 - RNA, 1701 nt, Artificial Sequence
  derived and/or modified sequence opt3 from hemagglutinin__InfluenzaA__ACZ45030
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaccuauuccaagaaauuuaagccugagauugcaauccgcccaaaagugcgagaucaggagggacguaugaauuacuauuggacacugguggaacccggugacaagauuacuuucgaggccaccggcaaccuagucguuccuagauacgcuuuuacaauggaaaggaacgccgggagcggaaucauaauuucggauaccccagugcaugacugcaauacgacuugucaaacaccgaaaggcgcaaucaacaccucucuccccuuccagaauauucacccuaucacuaucgguaagugcccaaaguauguaaaauccacaaagcugcggcuugcuaccgggcugcgcaacauucccucaauacagaguagaggauuguuuggcgccaucgcgggcuucauugaagggggauggacggguaugguggacggcugguacggguaucaucaccagaaugaacaaggaagcggcuacgccgcagaucucaaauccacccagaacgcuaucgacgagauaacaaauaaggucaacucugugauugagaaaaugaauacucaguuuaccgccguugguaaggaguucaaccaccuggaaaagaggaucgaaaauuuaaacaaaaagguggaugacggguuccuggauaucuggacauacaaugcugagcuccuuguccuguuggaaaacgagcggacucuagacuaucaugauagcaaugugaaaaaccuguacgagaagguacgcucacagcucaaaaacaaugccaaggaaauuggcaacggauguuuugaguucuaucacaagugcgacaauaccuguauggaaaguguuaaaaacggcacauacgauuauccuaaguacuccgaggaagcaaaacugaaucgagaggagaucgacggggugaaacuugaaagcaccagaauuuaucaaauacuggccaucuacucuacugucgcuucaaguuuggugcucgucgugagccugggagcgauuuccuuuuggaugugcucuaacgguucguuacagugcaggaucuguaucuga

SEQ ID NO: 125789 - RNA, 1701 nt, Artificial Sequence
  derived and/or modified sequence opt3 from hemagglutinin__InfluenzaA__ACZ45031
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuuaccauggagcggaacguggggagcggaaucauaauuucggacacaccaguacaugauugcaauaccacgugucaaacuccgaaaggcgccaucaacacaucucuccccuuccagaauauucacccuaucaccaucgguaagugcccaaaguaugugaaauccacuaagcugcgccuugcaacagggcugagaaacguccccucaauucagaguaggggauuguuuggcgcuauagccggcuucaucgaagggggauggaccgguaugguggacggcugguacggguaucaucaccagaaugagcaaggaagcggcuacgcggccgaccucaaauccacgcagaacgcaauugaugagaucaccaauaagguuaacucugugauagaaaagaugaauacacaguuuacugcugucgguaaggaguucaaccaccuggaaaagcggauugagaauuuaaacaaaaagguggacgauggguuccuggacaucuggaccuacaaugccgaacuccuuguacuguuggagaacgagcgcacacuagauuaucaugacagcaauguuaaaaaccuguacgaaaaggugcgaucacagcucaaaaacaaugcuaaggagaucggcaacggauguuuugaguucuaucacaagugcgauaauacuuguauggagagugucaaaaacggcaccuacgacuauccuaaguacuccgaagaggccaaacugaauagagaggaaauugauggggugaaacuugagagcacaaggaucuaucaaauucuggcaauauacucuaccgucgccucaaguuuggugcucguugugagccugggagcuaucuccuuuuggaugugcucuaacgguucguuacagugccggauuuguaucuga

SEQ ID NO: 125790 - RNA, 1701 nt, Artificial Sequence
  derived and/or modified sequence opt3 from hemagglutinin__InfluenzaA__ACZ45034
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauguacacccuauuacaaucgguaagugcccaaaguaugugaaauccaccaagcugcgccuugccacugggcugagaaacgugcccccuauccagucaaggggauuguuuggcgcgauugccggcuucauagaagggggauggacagguauggucgacggcugguacggguaucaucaccagaaugaacaaggaaguggcuacgcagcugaucucaaaagcacccagaacgccaucgacgagauuacgaauaagguuaacuccgugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauucuaauguuaaaaaccuguacgagaaggugcgaagccagcucaaaaacaaugcaaaggaaaucggcaacggauguuuugaguucuaucacaagugcgacaauacauguauggaaucagucaaaaacggcacuuacgauuauccaaaguacagugaggaagccaaacugaauagagaggagaucgacggggugaaacuugaauccaccaggauuuaucaaauccuggcuauuuacagcacagucgcgucuucauuggugcucguugugagucugggagcaaucagcuuuuggaugugcuccaacgguucuuuacagugccggauauguauuuga

SEQ ID NO: 125791 - RNA, 1701 nt, Artificial Sequence; identical to SEQ ID NO: 124685
  derived and/or modified sequence opt3 from hemagglutinin__InfluenzaA__ACZ45036

SEQ ID NO: 125792 - RNA, 1701 nt, Artificial Sequence; identical to SEQ ID NO: 124685
  derived and/or modified sequence opt3 from hemagglutinin__InfluenzaA__ACZ45037

SEQ ID NO: 125793 - RNA, 1701 nt, Artificial Sequence; identical to SEQ ID NO: 125786
  derived and/or modified sequence opt3 from hemagglutinin__InfluenzaA__ACZ45038

SEQ ID NO: 125794 - RNA, 1701 nt, Artificial Sequence; identical to SEQ ID NO: 125038
  derived and/or modified sequence opt3 from hemagglutinin__InfluenzaA__ACZ45039

SEQ ID NO: 125795 - RNA, 1701 nt, Artificial Sequence; identical to SEQ ID NO: 124685
  derived and/or modified sequence opt3 from hemagglutinin__InfluenzaA__ACZ45040

SEQ ID NO: 125796 - RNA, 1701 nt, Artificial Sequence; identical to SEQ ID NO: 124685
  derived and/or modified sequence opt3 from hemagglutinin__InfluenzaA__ACZ52567

SEQ ID NO: 125797 - RNA, 1701 nt, Artificial Sequence; identical to SEQ ID NO: 124685
  derived and/or modified sequence opt3 from hemagglutinin__InfluenzaA__ACZ52568

SEQ ID NO: 125798 - RNA, 1701 nt, Artificial Sequence; identical to SEQ ID NO: 125254
  derived and/or modified sequence opt3 from hemagglutinin__InfluenzaA__ACZ52569

SEQ ID NO: 125799 - RNA, 1701 nt, Artificial Sequence
  derived and/or modified sequence opt3 from hemagglutinin__InfluenzaA__ACZ53956
augaagaccaucauugcccugagcuacauauucugccucgcucuugcacagaaacugcccggcaacgacaauuccacagccacuuuguguuuagggcaccaugcggugccuaacggaacgcuggucaagaccaucacaaaugaucaaauugagguuacuaacgcuaccgaacuugugcagucuucaaguacagguagaaucugcgacagcccacaccagauucucgauggcgagaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucaguacgcucaacugguuacaccagcugcagaaucguuauccagcucuuaacguuacuaugcccaauaacgacaaguuugauaaauuguacaucuggggagugcaucacccuagcaccgacucugaucagauuuccgucuaugcccaagcgucaggcagagugacaguaagcacuaagaggagucagcagaccguuaucccaaacauuggcucucggcccugggugcgcggggucuccagcagaaucucgauauacuggacaauugugaaaccuggagacauccugcuaauuaauucuaccgguaaccucaucgcaccaaggggcuacuucaagauccgguccgggaaaucaaguauuaugcgcagcgacgccccgauaggaaaguguaauuccgagugcaucacgcccaacggcucuauuccuaaugauaagccauuucagaacgugaaucgaaucacuuauggugcuugucccagauacgucaaacaaaacacacugaagcuagccaccgggaugaggaauguuccugaaaaacagacucggggaauauucggcgcaauugcuggcuuuaucgagaacgggugggaaggaaugauggacgguugguauggcuuccgucaccagaauagcgaggggacaggacaagccgcggaucugaagucaacccaggccgcaaucaaccagauuaauggcaaauugaaccgccucaucgagaagacgaaugaaaaauuucaucagauugagaaggaguucagugaaguggaagguagaauacaagaccuggagaaguacguagaggauaccaaaaucgacuuaugguccuauaacgcugaacugcucguggcccuugagaaccagcacacaauugaucugacugacagcgaaaugaauaaguuguucgagaggacccggaaacagcuacgagaaaacgcugaggauauggggaauggcugcuuuaagaucuaccauaaaugugacaacgccugcaucggaucuauucgcaauggcacauaugaucacgacgucuacagagacgaggcacugaacaauagguuccagauaaaggggguggaacucaagucaggauacaaagauuggauccuguggauuaguuuugccaucagcugcuuccuucuguguguuguguugcucgguuuuauuaugugggcuugccaacggggcaacauccgcuguaauauaugcaucuga

SEQ ID NO: 125800 - RNA, 1701 nt, Artificial Sequence
  derived and/or modified sequence opt3 from hemagglutinin__InfluenzaA__ACZ53967
augaagaccaucauugcccugagcuacauauucugccucgcucuugcacagaaacugcccggcaacgacaauuccacagccacuuuguguuuagggcaccaugcggugccuaacggaacgcuggucaagaccaucacaaaugaucaaauugagguuacuaacgcuaccgaacuugugcagucuucaaguacagguagaaucugcgacagcccacaccagauucucgauggcgagaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucaguacgcucaacugguuacaccagcugcagaaucguuauccagcucuuaacguuacuaugcccaauaacgacaaguuugauaaauuguacaucuggggagugcaucacccuagcaccgacucugaucagacaucccuguaugcccaagcgucaggcagagucacugugagcaccaagaggagucagcagacaguaauuccaaacaucggcucucggcccuggguucgcgggguguccagcagaauuucgaucuacuggaccauagucaaaccuggagacgugcuagugauuaauucuaacgguaaucucaucgcaccaaggggcuacuucaagaugcgguccgggaaaucaaguauuaugcgcagcgacgccccgaucggaaaguguaacuccgagugcaucacgcccaauggcucuauuccuaacgauaagccauuucagaaugucaaccgaauaacuuauggugcuugucccagauacguuaaacaaaauacacugaagcuagccaccgggaugaggaacgugccugaaaaacagacucggggaaucuucggcgcaauugcuggcuuuaucgagaaugggugggaaggaaugauggacgguugguauggcuuccgucaccagaacagcgaggggacaggacaagccgcggaucugaagucaacccaggccgcaauaaaucagauuaacggcaaauugaauaagcucaucgagaaaacgaacgaaaaguuucaucagaucgagaaggaguucagugaaguagaaggucgcauucaagaccuggagaaauacguggaggauaccaagaucgacuuaugguccuauaacgcugaacugcucgucgcccuugagaaucagcacacaauugaucugacugacagcgaaaugaacaaauuguucgagagaaccaggaagcagcuacgggaaaaugcugaggauauggggaacggcugcuuuaaaauauaccauaagugugacaaugccugcaucggaucuauucgaaacggcacauaugaucacgacguguaccgcgacgaggcacugaauaacagauuccagaucaaggggguugaacucaaaucaggauacaaggauuggauccuguggauuaguuuugccauaagcugcuuccuucuguguguggucuugcucgguuccaucaugugggcuugccaaaggggcaauauucgguguaacaucugcauuuga

SEQ ID NO: 125801 - RNA, 1701 nt, Artificial Sequence
  derived and/or modified sequence opt3 from hemagglutinin__InfluenzaA__ACZ53978
augaagaccaucauugcccugagcuacauauucugccucgcucuugcacagaaacugcccggcaacgacaauuccacagccacuuuguguuuagggcaccaugcggugccuaacggaacgcuggucaagaccaucacaaaugaucaaauugagguuacuaacgcuaccgaacuugugcagucuucaaguacagguagaaucugcgacagcccacaccagauucucgauggcgagaauuguacccugaucgacgcccuucugggggauccgcauugcgacggauuucagaacaaagaaugggauuuguucguagagagguccaaggcauauucuaauuguuaccccuaugacgugccugauuacgccucgcucaaaucacugauagcuagcaguggcacucuggaauuuaacaaugaguccuucaacuggaucggugucucucaaaaugggacaagcuccgcaugcaagcggauuucaaucaccgugaguuuuaacaagcucaauugguuacaccagcugaaauaucgcuacccagcccuuaacguuacgaugcccaauaacgacaaguucgauaaauuguauauuuggggagugcaucacccuagcacugacucugaucagaccucccuguacgcucaggccucaggccgagucacagugagcacuaagcguagucaacagaccguaaucccaaacauaggcucuagacccuggguuaggggaguguccagccggauuucgaucuacuggacaauugucaaaccuggggacgugcuagugaucaauucuaacgguaaucucaucgcgccacgcggcuauuuuaagaugagauccgggaagucaaguauuaugaggagcgacgcaccgauaggaaaauguaacuccgagugcaucacccccaauggcucuauuccuaacgauaagccauuccagaaugucaaccggaucacguacggugccuguccccgcuauguuaaacagaauacucugaagcuagcuacagggaugcgaaacgugccugaaaaacaaaccagaggaauauuuggcgccauugcaggcuucaucgagaaugggugggaaggaaugguagacgguugguacggcuuuaggcaccagaacagcgaggggacuggacaggcugccgaucugaagucaacacaagcggccaucaaucagauuaccggcaaauugaacaagcucaucgagaagacgaaugaaaaauuccaucagauugagaaggaauuuagugagguggaaggucggauacaggaccuggagaaauaugucgaggauaccaagaucgacuuaugguccuacaacgcagaacugcucguggcucuugagaaccaacacacaauugaucugacugacagcgaaaugaauaaauuguucgagcguacccgcaagcagcuaagagaaaacgccgaggauauggggaauggcugcuucaagaucuaucauaaaugugacaacgcuugcaucggaucuauuaggaauggcacauacgaucacgacguuuaccgggacgaggcccugaacaaucgauuucagauaaaggggguggaacucaaaucaggauauaaggauuggauccuguggauuaguuucgcaaucagcugcuuucuucugugugucguguugcucgguuucauuaugugggccugccagcgcggcaacaucagauguaauauaugcaucuga

SEQ ID NO: 125802 - RNA, 1701 nt, Artificial Sequence
  derived and/or modified sequence opt3 from hemagglutinin__InfluenzaA__ACZ56080
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcguggacaggaggguagaaugaauuacuauuggacccugguggaaccaggcgauaagauuacauucgaggccacugggaaccuagucguucccagguacgcuuuugccauggaacggaacgcaggaucgggcaucauaauuucugacaccccugugcaugauugcaauacaaccugucaaacgccaaaaggugcuaucaacacuucccucccguuccagaauauucaccccaucacaaucgggaagugcccuaaguauguaaaaucaaccaagcugcgccuugccacuggacugagaaacgugccaaguauucagagcaggggcuuguuuggcgcgauagccggguucaucgagggagguuggacaggcauggucgacgggugguacggauaucaucaccagaaugaacaaggcuccgguuacgcagcugaccucaaaucuacccagaacgccauugaugagaucacgaauaaggugaacagcguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacucaaauguuaaaaaccuguacgagaagguacgaagucagcucaaaaacaaugcaaaggaaaucggaaacggcuguuuugaguucuaucacaagugcgauaauacauguauggaauccgugaaaaacgggacuuacgacuaucccaaguacagcgaggaagccaaacugaauagagaggagauugauggagucaaacuugaaucuaccaggaucuaucaaauucuggcuauauacucaacaguggcgaguagcuugguccucgugguuucccugggugcaaucucuuuuuggaugugcucgaacggcagcuuacagugccggauuuguaucuga

SEQ ID NO: 125803 - RNA, 1701 nt, Artificial Sequence
  derived and/or modified sequence opt3 from hemagglutinin__InfluenzaA__ACZ61118
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccaaucaacgagcgcugaucagcagaguuuguaccagaacgccgacgcguacguguucgucgggucuucccgcuauagcaagaaauuuaagcccgagauugcaauccgaccuaaagugcgugaucaagagggaagaaugaauuacuauuggacucugguggaaccaggugacaagauuaccuucgaggccacaggcaaccuagucguucccagguacgcuuuugccauggaacggaacgcagggucgggaaucauaauuucugauacuccugugcaugacugcaauaccacaugucagaccccaaaaggcgcuaucaacacgucccucccguuccagaauauucaccccaucacuaucgguaagugcccuaaguauguaaaaucaacaaagcugcgccuugccaccgggcugagaaacgugccaaguauucagagcaggggauuguuuggcgcgauagccggcuucaucgaagggggauggacugguauggucgacggcugguacggguaucaucaccaaaaugaacagggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucaacucaaaaacaaugcaaaggaaaucggcaacggauguuuugaguucuaucacaagugcgacaauaccuguauggaauccgugaaaaacggcacauacgauuaucccaaguacagcgaggaagccaaacugaauagagaggagauugacggggucaaacuugaaucuacuaggaucuaucagauucuggcuauauacucaaccguggcgaguagcuugguccucgugguuucccugggagcaaucucuuuuuggaugugcucgaacgguagcuuacagugccggauuuguaucuga

SEQ ID NO: 125804 - RNA, 1701 nt, Artificial Sequence
  derived and/or modified sequence opt3 from hemagglutinin__InfluenzaA__ACZ61119
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuuauccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacaaugccggaucuguaucuga

SEQ ID NO: 125805 - RNA, 1701 nt, Artificial Sequence; identical to SEQ ID NO: 124685
  derived and/or modified sequence opt3 from hemagglutinin__InfluenzaA__ACZ61122

SEQ ID NO: 125806 - RNA, 1701 nt, Artificial Sequence; identical to SEQ ID NO: 124685
  derived and/or modified sequence opt3 from hemagglutinin__InfluenzaA__ACZ61123

SEQ ID NO: 125807 - RNA, 1701 nt, Artificial Sequence; identical to SEQ ID NO: 125483
  derived and/or modified sequence opt3 from hemagglutinin__InfluenzaA__ACZ74627

SEQ ID NO: 125808 - RNA, 1698 nt, Artificial Sequence
  derived and/or modified sequence opt3 from hemagglutinin__InfluenzaA__ACZ81554
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacaaucacaacgggaaacuaugccuccugaagggaauagcgccccuucagcuggguaauuguaccguggccggcuggaucuuggggaacccugagugcgaacuccugauuucuaaagagucauggaguuacaucguugaaaagccaaauccggagaacggaacuuguuaucccggccauuuugcugauuacgaggaacugagagagcaacucagcuccgugucuucguucgaaagguuugagauuuucccuaaggagucaagcuggccaaaucacacagucaccggugugagugccuccugcucucauaacggggaaaauagcuuuuaucggaacuuacuguggcuuacgggcaaaaauggauuguaccccaaccuguccaagucauaugcaaacaauaaagagaaggaaguucuaguacucuggggcgugcaccacccuccaaacaucgccgaccagaaaacucuguaccauaccgagaaugcuuacgucaguguggugagcucucacuauucccgcaaguucacacccgaaauagcaaagcgaccuaaaauccgugaucaggaggggagaauuaacuacuauuggacucuucuggagccaggagacaccaucauuuuugaagccaaugguaacuugaucgcuccgagguacgccuucgcgcucucacggggcuuugggagcggaauaauuaauaguaacgcacccauggauaagugugacgccaaaugccagacaccucaaggcgcuaucaauucuucccugccauuccagaacguccaucccguuaccauuggugaguguccuaaguaugugcgcagcgccaaauuaagaaugguaacggggcugaggaauaucccaucgauccagucucggggacucuuuggcgcaauugcuggcuucauagaagggggauggacugguaugguggauggcugguacggguaucaccaccagaacgagcaaggauccggcuacgccgcggaccagaagucaacacagaaugccaucaacgguauuaccaauaaagucaacagugugaucgaaaagaugaacacucaguuuacagcaguugggaaggaguucaauaaacuugagcgccgaauggaaaaccugaauaagaaaguggaugacggcuucauagauauuuggaccuacaacgcugaguugcuaguccugcucgaaaaugagagaacgcuggacuuucaugacagcaacgugaagaaucuuuaugaaaaaguaaagucccaacugaagaacaaugccaaagagaucggaaacggcugcuucgaguuuuaccacaaguguaaugaugaaugcauggagucuguuaaaaacgggaccuaugacuaccccaaguauagcgaagagucaaaauugaauagggagaagaucgauggagugaagcucgaaaguaugggugucuaccagauucuggcuaucuauuccacaguggccagcucuuuaguccugcuagugucacucggcgcaauuaguuucuggaugugcagcaacgggucccugcagugucggauaugcaucuga

SEQ ID NO: 125809 - RNA, 1698 nt, Artificial Sequence
  derived and/or modified sequence opt3 from hemagglutinin__InfluenzaA__ACZ81555
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucggggaccagaaaacgcuguaccauacugagaacgccuacgucucugugguguccucacacuauagccgcaaguucacccccgaaauagcuaagcgaccuaaaguccgugaucaggagggaagaaucaauuacuauugggcacuucuggagccaggugacacaauuaucuuugaagccaacggcaauuugauugcuccgagguacgccuucgcgcucagucggggguuuggaucuggcaucauaaacuccaaugcacccauggauaagugugacgccaaaugccagacuccucaaggugcuauuaacagcucgcugccauuccagaauguucaucccgugaccaucggggaguguccuaaguauguacgcucugccaaauuaagaauggugacaggacugaggaacauuccauccauccagucacggggccucuuuggcgcaaucgcuggguucauugaaggagguuggaccggcauggucgaugggugguacggauaucaccaccagaaugagcaaggcagugguuacgccgcggaccagaaaagcacgcagaacgccauaaaugggaucacuaacaaaguaaauuccguuauugaaaagaugaacacacaguuuaccgcagugggcaaggaguucaacaaacuugagcgccgaauggaaaaucugaacaagaaagucgaugacggauucaucgauauauggacuuacaaugcugaguugcuagugcugcucgaaaacgagagaacacuggacuuucaugacucuaauguaaagaaccuuuaugaaaaaguuaagagccaacugaagaauaacgccaaagagauuggcaaugggugcuucgaguuuuaccacaaguguaacgaugaaugcauggagucagugaaaaauggaaccuaugacuaccccaaguauagugaagaguccaaauugaacagggagaagaucgauggugucaagcucgaaagcaugggcguguaccagauccuggcuauuuauucuacggucgccucaaguuuagugcugcuaguuagccucggggcaaucuccuucuggaugugcucuaauggaucgcugcagugucggauuugcauauga

SEQ ID NO: 125810 - RNA, 1698 nt, Artificial Sequence
  derived and/or modified sequence opt3 from hemagglutinin__InfluenzaA__ACZ81556
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugccucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcugaccagaaaacgcuguaccauacugagaacgcauacgugucugucguguccucacacuauagccgcaaguucacccccgaaauagccaagcgaccuaaagugcgugaucaggaggggagaaucaauuacuauuggacacuucuggagccaggagacacuauuaucuuugaagcuaacgguaauuugauugccccgagguacgcguucgcacucagucggggcuuugggucuggaaucauaaacuccaaugcccccauggauaagugugacgcuaaaugccagaccccucaaggcgccauuaacagcucgcugccauuccagaauguccaucccguuacaaucggugaguguccuaaguaugugcgcucugcaaaauuaagaaugguaaccgggcugaggaacauuccauccauccagucacggggacucuuuggcgcuaucgccggcuucauugaagggggauggacggguaugguggauggcugguacggguaucaccaccagaaugagcaaggaaguggcuacgcggccgaccagaaaagcacucagaacgcaauaaaugguaucacaaacaaagucaauuccgugauugaaaagaugaacacccaguuuacugcuguugggaaggaguucaacaaacuugagcgccgaauggaaaaucugaacaagaaaguggaugacggcuucaucgauauauggacauacaaugccgaguugcuaguccugcucgaaaacgagagaacccuggacuuucaugacucuaaugugaagaaccuuuaugaaaaaguaaagagccaacugaagaauaacgcuaaagagauuggaaauggcugcuucgaguuuuaccacaaguguaacgaugaaugcauggagucaguuaaaaaugggacguaugacuaccccaaguauagugaagaguccaaauugaacaaggagaagaucgauggagugaaacucgaaagcaugggugucuaccagauccuggccauuuauucuaccguggcaucaaguuuaguccugcuagugagccucggcgccaucuccuucuggaugugcucuaaugggucgcugcaguguaggauuugcauauga

SEQ ID NO: 125811 - RNA, 1701 nt, Artificial Sequence
  derived and/or modified sequence opt3 from hemagglutinin__InfluenzaA__ACZ81557
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcggcagcccacaccagauccuagacgggaaaaauuguacccucauagaugcucugcuuggagacccgcagugcgauggcuuucaaaacaagaaaugggaccuguucguggaaagauccaaggccuauucuaauuguuaccccuaugaugucccugacuacgcaucguugaggucacucguggccagcagugguacucuggaguuuaacaaugaauccuucaacuggacagggguuacccagaauggaacgucuagcgcuugcauccggcgcuccaagaacucauuuuucagucgacugaauuggcucacucauuuaaacuuuaaauaucaggcacugaaugugaccaugccaaacaacgagcaguucgauaagcuguacauuuggggcguccaccaucccggcacagacaaagaucaaaucuuuuuguaugcccaggcuagcgggcguauuacugugucuaccaagagaucccagcagacaguaaucccuaauauaggaucaaggccacggguucgcaacauucccagcagaaucaguauuuacuggaccaucgugaaaccuggugacauccugcuaauuaauucuacgggcaaccucauagccccaaggggguacuucaagauccaauccggaaagagcucgauuaugcggucugaugcgccgaucggcaaauguaauuccgagugcauaacucccaacgguucaauuccuaaugacaagccauuucagaacgucaaucgcaucacauauggggcauguccccgauacgugaaacagaacacccugaaacuugccacuggaaugagaaaugugccugaaaaacaaacaaggggcaucuucggcgcuauugccggguuuaucgagaacggaugggaagguauggucgacggcugguauggguuccggcaccagaauagugagggacguggccaggcagcugaucuuaagagcacccaggccgcgauugaccaaauaaacgguaaauugaaucgccucaucgggaagacgaacgagaaguuccaccagauugaaaaagaguuuuccgaaguugagggcagaauccaggaucuggaaaaguacguggaggacaccaaaaucgauuuauggucuuauaacgccgagcugcucguagcacuugaaaaucagcauacaauugaccugacugauagcgagaugaacaaguuguucgaaaagaccaagaagcaacuaagggagaaugcugaagacaugggaaacggcugcuuuaaaauauaccacaagugugauaaugccugcaucgggucaauucggaacggaacauaugaccaugauguguaccgagacgaggcucugaauaaccgcuuccagaucaaaggugucgagcucaagaguggcuacaaagacuggauucuguggaucuccuuugccauaagcugcuuccuucuguguguggcauugcucggguuuaucaugugggccugccagaagggaaauauuagauguaacaucugcauuuga

SEQ ID NO: 125812 - RNA, 1701 nt, Artificial Sequence
  derived and/or modified sequence opt3 from hemagglutinin__InfluenzaA__ACZ81558
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcauugcgacggauuucagaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaaaaugggacgucuagcgcuugcauccggcgcuccaagaacucauuuuucagucgacugaauuggcucacucacuuaaacuuuaaauauccagcacugaaugugaccaugcccaacaacgagcaguucgacaagcuguacauuuggggaguccaucacccuggcacagauaaagaccagaucuuuuuguaugcccaggcuagcggccguauuacugugucuaccaagagaucccaacagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacagaacacccugaaacuugcuacugggaugaggaaugugccagaaaagcaaacacggggaaucuucggcgccauugcaggcuuuaucgagaacgggugggaaggaaugguggaugguugguauggcuuccgucaccagaauagugaggggcgcggacaggcugccgaccuuaagagcacccaagcggccauugaucagauaaacggcaaauugaauagacucaucgagaagacgaacgaaaaguuccaucagauugagaaagaauuuuccgaggucgaagguaggauccaggaccuggagaaguacguugaggauaccaaaaucgacuuauggucuuauaacgcagaacugcucguggcucuugagaaucaacacacaauugaucugacugacagcgaaaugaacaaguuguucgagaaaaccaagaagcagcuacgggaaaaugccgaggauauggggaacggcugcuuuaaaauauaccauaagugugacaaugcuugcaucggaucaauucgaaacggcacauaugaucacgacguauaccgcgacgaggcccugaauaacagauuccagaucaaagggguggaacucaagaguggauacaaagauuggauucuguggaucuccuuugcaauaagcugcuuccuucugugugucgccuugcucgguuuuaucaugugggcuugccagaagggcaauauuagguguaacaucugcauuuga

SEQ ID NO: 125813 - RNA, 1701 nt, Artificial Sequence
  derived and/or modified sequence opt3 from hemagglutinin__InfluenzaA__ACZ81559
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcauugcgacggauuucagaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaaaaugggacgucuagcgcuugcauccggcgcuccaagaacucauuuuucagucgacugaauuggcucacucacuuaaacuuuaaauauccagcacugaaugugaccaugcccaacaacgagcaguucgacaagcuguacauuuggggaguccaucacccuggcacagauaaagaccagaucuuuuuguaugcccaggcuagcggccguauuacugugucuaccaagagaucccaacagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacagaacacccugaaacuugcuacugggaugaggaaugugccagaaaaacaaacacggggaaucuucggcgccauugcaggcuuuaucgagaacgggugggaaggaaugguggaugguugguauggcuuccgucaccagaauagugaggggcgcggacaggcugccgaccuuaagagcacccaagcggccauugaucagauaaacggcaaauugaauagacucaucgguaagacgaacgagaaguuccaucagauugaaaaagaguuuuccgaagucgaggggaggauccaggaccuggaaaaguacguugaggauaccaaaaucgacuuauggucuuauaacgcagagcugcucguggcucuugaaaaucaacacacaauugaucugacugacagcgagaugaacaaguuguucgaaaagaccaagaagcagcuacgggagaaugccgaagauaugggcaacggaugcuuuaaaauauaccauaagugugacaaugcuugcaucggcucaauucgaaacgggacauaugaucacgacguauaccgcgacgaggcccugaauaacagauuccagaucaaaggaguggagcucaagagugguuacaaagauuggauucuguggaucuccuuugcaauaagcugcuuccuucugugugucgccuugcucggcuuuaucaugugggcuugccagaaggggaauauuagguguaacaucugcauuuga

SEQ ID NO: 125814 - RNA, 1701 nt, Artificial Sequence; identical to SEQ ID NO: 124685
  derived and/or modified sequence opt3 from hemagglutinin__InfluenzaA__ACZ81632

SEQ ID NO: 125815 - RNA, 1701 nt, Artificial Sequence; identical to SEQ ID NO: 124685
  derived and/or modified sequence opt3 from hemagglutinin__InfluenzaA__ACZ81642

SEQ ID NO: 125816 - RNA, 1701 nt, Artificial Sequence
  derived and/or modified sequence opt3 from hemagglutinin__InfluenzaA__ACZ81652
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcagaagccaagaguuuuuauaaaaaucugaucuggcucgugaagaaagggaacagcuacccaaaguuaucuaaauccuauauaaaugacaagggaaaggagguacugguucuuuggggcauccaccaccccucaacgagcgcugaucaacagaguuuguaccagaacgccgacgcguacguguucgucggcacuucucgauauuccaaaaaguuuaaaccugagauugcaauccguccaaaggugagagggcaggaaggaaggaugaauuacuauuggacccugguggagcccggugauaaaauuacauucgaagccacuggcaaccuagucguuccucgguacgcuuuugccauggagcgcaacgcagggagcggaaucauaauuucggacaccccagugcaugauugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugagcaaggaagcggcuacgcagcugaccucaaguccacccagaacgccauugaugagaucacgaauaaagugaacucuguuauagaaaagaugaauacccaguuuacagcuguggguaaagaguucaaccaccuggaaaagcgcauugagaauuuaaacaagaaagucgacgauggguuccuggacaucuggacuuacaaugccgaacuccuugugcuguuggagaacgagcgaacccuagauuaucaugacagcaauguaaagaaccuguacgaaaaaguuagaucacagcucaagaacaaugcaaaagagaucggcaacggauguuuugaguucuaucacaagugcgauaauacauguauggagagugugaagaacggcacuuacgacuauccuaaauacuccgaagaggccaagcugaauagggaggaaauugauggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 125817 - RNA, 1701 nt, Artificial Sequence
  derived and/or modified sequence opt3 from hemagglutinin__InfluenzaA__ACZ92130
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauugaauccgugaagaacggcacauacgauuauccuaaauacagcgaagaggccaagcugaauagagaggaaaucgacggggucaaacuugagucuacuaggauuuaucagauacuggcuaucuacucaaccguggcgaguagcuugguccucgugguuucccugggagcaauuucuuuuuggaugugcucgaacgguagcuuacaaugccggaucuguaucuga

SEQ ID NO: 125818 - RNA, 1701 nt, Artificial Sequence; identical to SEQ ID NO: 124927
  derived and/or modified sequence opt3 from hemagglutinin__InfluenzaA__ACZ92131

SEQ ID NO: 125819 - RNA, 1701 nt, Artificial Sequence; identical to SEQ ID NO: 124927
  derived and/or modified sequence opt3 from hemagglutinin__InfluenzaA__ACZ92132

SEQ ID NO: 125820 - RNA, 1701 nt, Artificial Sequence; identical to SEQ ID NO: 124927
  derived and/or modified sequence opt3 from hemagglutinin__InfluenzaA__ACZ92133

SEQ ID NO: 125821 - RNA, 1701 nt, Artificial Sequence; identical to SEQ ID NO: 124685
  derived and/or modified sequence opt3 from hemagglutinin__InfluenzaA__ACZ92134

SEQ ID NO: 125822 - RNA, 1701 nt, Artificial Sequence; identical to SEQ ID NO: 124685
  derived and/or modified sequence opt3 from hemagglutinin__InfluenzaA__ACZ95465

SEQ ID NO: 125823 - RNA, 1701 nt, Artificial Sequence; identical to SEQ ID NO: 124672
  derived and/or modified sequence opt3 from hemagglutinin__InfluenzaA__ACZ95837

SEQ ID NO: 125824 - RNA, 1701 nt, Artificial Sequence; identical to SEQ ID NO: 124685
  derived and/or modified sequence opt3 from hemagglutinin__InfluenzaA__ACZ95847

SEQ ID NO: 125825 - RNA, 1701 nt, Artificial Sequence
  derived and/or modified sequence opt3 from hemagglutinin__InfluenzaA__ACZ95857
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgucuaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 125826 - RNA, 1701 nt, Artificial Sequence; identical to SEQ ID NO: 124685
  derived and/or modified sequence opt3 from hemagglutinin__InfluenzaA__ACZ95867

SEQ ID NO: 125827 - RNA, 1701 nt, Artificial Sequence
  derived and/or modified sequence opt3 from hemagglutinin__InfluenzaA__ACZ95887
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcguaaucaggaaggaagaaugaacuacuauuggacucugguggagcccggugauaaaauuaccuucgaagccacaggcaaccuagucguuccuagguacgcuuuugccauggagcggaaugcagggucgggaaucauaauuucugacacuccagugcaugauugcaacaccacaugucaaaccccgaagggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgacggcugguacggguaucaccaccagaacgagcagggauccggcuacgcagcugaccucaagucuacacaaaaugccauugaugagaucaccaacaaagugaauagcguuauagaaaagaugaacacgcaguuuaccgcuguggguaaagaguucaaucaucuggaaaagcggauugagaacuuaaauaagaaagucgacgauggguuccuggacaucuggacauacaacgccgaacuccuugugcuguuggagaaugagcgcacucuagauuaucacgacucaaacguaaagaaccuguacgaaaaaguucgaagucagcucaagaauaacgcaaaagagaucggcaauggauguuuugaguucuaucauaagugcgauaacaccuguauggaauccgugaagaauggcacauacgacuauccuaaauacagcgaagaggccaagcugaacagagaggaaauugauggggucaaacuugagucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 125828 - RNA, 1701 nt, Artificial Sequence; identical to SEQ ID NO: 124685
  derived and/or modified sequence opt3 from hemagglutinin__InfluenzaA__ACZ95897

SEQ ID NO: 125829 - RNA, 1701 nt, Artificial Sequence
  derived and/or modified sequence opt3 from hemagglutinin__InfluenzaA__ACZ95907
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccaguguaugacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaucagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuauaaugccgagcuccuugugcuguuggaaaacgagcgcacccuagacuaccacgauagcaauguaaagaaccuguaugagaagguucgaucacagcucaaaaacaaugcaaaggaaaucggcaacggauguuuugaguucuaccauaagugcgacaauacauguauggaaagugugaaaaacggcacuuaugauuacccuaaguauuccgaggaagccaaacugaauagagaggagauugacggggucaaacuugaaagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 125830 - RNA, 1701 nt, Artificial Sequence; identical to SEQ ID NO: 124685
  derived and/or modified sequence opt3 from hemagglutinin__InfluenzaA__ACZ95927

SEQ ID NO: 125831 - RNA, 1701 nt, Artificial Sequence
  derived and/or modified sequence opt3 from hemagglutinin__InfluenzaA__ACZ95937
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgaacgcugaucaacagagcuuguaccagaaugccgacgcguacguguucgucgggaguucucgcuauuccaaaaaguuuaaaccugagauugcaauccgaccaaaggugcgugaucaggaaggaagaaugaacuacuauuggacucugguggagcccggugacaaaauuaccuucgaagccacaggcaaccuagucguuccuagguacgcuuuugccauggagcggaaugcagggagcggaaucauaauuucggauacuccagugcaugacugcaacaccacaugucaaaccccgaagggcgcuaucaauacgucucuccccuuccacaacauucauccuaucacuaucgguaaaugcccaaaguauguaaaguccacaaaacugcgccuugccaccgggcugagaaaugugcccucaauucagaguaggggauuguuuggcgcgauagccggcuucaucgaagggggauggacugguauggucgacggcugguacggguaucaccaccagaacgagcagggaagcggcuacgcagcugaucucaaguccacacaaaaugccauugacgagaucaccaacaaaguuaauucugugauagaaaagaugaacacgcaguuuaccgcuguggguaaagaguucaaucaucuggaaaagcggauugagaacuuaaauaagaaagucgaugacggguuccuggauaucuggacauacaacgccgaacuccuugugcuguuggagaaugagcgcacucuagacuaucacgauagcaacguaaagaaccuguacgaaaaaguucgaucacagcucaagaauaacgcaaaagagaucggcaauggauguuuugaguucuaucauaagugcgacaacaccuguauggaaagugugaagaauggcacauacgauuauccuaaauacuccgaagaggccaagcugaacagagaggaaauugacggggucaaacuugagagcacuaggaucuaucagauucuggcuauauacucuaccguggcgucaaguuugguccucgugguuagccugggagcaaucuccuuuuggaugugcucuaaugguucguuacaaugccggauuuguaucuga

SEQ ID NO: 125832 - RNA, 1701 nt, Artificial Sequence; identical to SEQ ID NO: 124927
  derived and/or modified sequence opt3 from hemagglutinin__InfluenzaA__ACZ95947

SEQ ID NO: 125833 - RNA, 1701 nt, Artificial Sequence; identical to SEQ ID NO: 124685
  derived and/or modified sequence opt3 from hemagglutinin__InfluenzaA__ACZ95957

SEQ ID NO: 125834 - RNA, 1701 nt, Artificial Sequence; identical to SEQ ID NO: 124927
  derived and/or modified sequence opt3 from hemagglutinin__InfluenzaA__ACZ95967

SEQ ID NO: 125835 - RNA, 1701 nt, Artificial Sequence; identical to SEQ ID NO: 125831
  derived and/or modified sequence opt3 from hemagglutinin__InfluenzaA__ACZ95977

SEQ ID NO: 125836 - RNA, 1701 nt, Artificial Sequence
  derived and/or modified sequence opt3 from hemagglutinin__InfluenzaA__ACZ95987
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugaucgacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 125837 - RNA, 1701 nt, Artificial Sequence; identical to SEQ ID NO: 124685
  derived and/or modified sequence opt3 from hemagglutinin__InfluenzaA__ACZ95997

SEQ ID NO: 125838 - RNA, 1701 nt, Artificial Sequence; identical to SEQ ID NO: 124685
  derived and/or modified sequence opt3 from hemagglutinin__InfluenzaA__ACZ96007

SEQ ID NO: 125839 - RNA, 1701 nt, Artificial Sequence; identical to SEQ ID NO: 124672
  derived and/or modified sequence opt3 from hemagglutinin__InfluenzaA__ACZ96017

SEQ ID NO: 125840 - RNA, 1701 nt, Artificial Sequence; identical to SEQ ID NO: 124685
  derived and/or modified sequence opt3 from hemagglutinin__InfluenzaA__ACZ96027

SEQ ID NO: 125841 - RNA, 1701 nt, Artificial Sequence; identical to SEQ ID NO: 125831
  derived and/or modified sequence opt3 from hemagglutinin__InfluenzaA__ACZ96047

SEQ ID NO: 125842 - RNA, 1701 nt, Artificial Sequence
  derived and/or modified sequence opt3 from hemagglutinin__InfluenzaA__ACZ96057
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggacuucucgcuauuccaagaaauuuaagcccgagauugcaauccgaccuaaagugcgugaucaggagggaagaaugaauuacuauuggacccuaguggaaccaggugacaagauuacauucgaggccacuggcaaccucgucguucccagguacgcuuuugccauggaacggaacgcagggagcggaaucauaauuucggauaccccugugcaugacugcaauacaaccugucaaacgccaaaaggcgcuaucaacacuucucugccguuccagaauauucaccccaucacaaucgguaagugcccuaaguauguaaaauccaccaaacuucgccuggccacuggguugagaaacauuccaucaauacagaguaggggacucuuuggcgcgaucgccggcuucauugaagggggauggacagguaugguggacggcugguacggguaucaucaccagaaugaacaaggaagcggcuacgcagcugaucugaaguccacccagaacgccaucgacgagauaacgaauaaggucaacucugugauugagaaaaugaauacccaguuuacagcuguugguaaggaguucaaccacuuagaaaagcggaucgaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaauuggcaacggauguuuugaguucuaucacaagugcgacaauacauguauggaaaguguuaaaaacggcacuuacgauuaucccaaguacuccgaggaagccaaacuuaauagagaggagaucgacggggugaagcuggaaagcaccaggauuuaucaaauauuggcuaucuacucuacagucgcgucaagucucgugcuggucgugagcuuaggagcaauuuccuuuuggaugugcucuaacgguucgcugcagugccggaucuguaucuga

SEQ ID NO: 125843 - RNA, 1701 nt, Artificial Sequence
  derived and/or modified sequence opt3 from hemagglutinin__InfluenzaA__ACZ96069
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccgguaacaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125844 - RNA, 1701 nt, Artificial Sequence; identical to SEQ ID NO: 125831
  derived and/or modified sequence opt3 from hemagglutinin__InfluenzaA__ACZ96089

SEQ ID NO: 125845 - RNA, 1701 nt, Artificial Sequence
  derived and/or modified sequence opt3 from hemagglutinin__InfluenzaA__ACZ96119
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacgagauuacgaauaaggugaacucuguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagaucgacggggucaaacuugaaagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 125846 - RNA, 1701 nt, Artificial Sequence
  derived and/or modified sequence opt3 from hemagglutinin__InfluenzaA__ACZ96129
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgaauuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125847 - RNA, 1701 nt, Artificial Sequence; identical to SEQ ID NO: 124685
  derived and/or modified sequence opt3 from hemagglutinin__InfluenzaA__ACZ96149

SEQ ID NO: 125848 - RNA, 1701 nt, Artificial Sequence; identical to SEQ ID NO: 124685
  derived and/or modified sequence opt3 from hemagglutinin__InfluenzaA__ACZ96159

SEQ ID NO: 125849 - RNA, 1701 nt, Artificial Sequence
  derived and/or modified sequence opt3 from hemagglutinin__InfluenzaA__ACZ96179
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125850 - RNA, 1701 nt, Artificial Sequence; identical to SEQ ID NO: 125842
  derived and/or modified sequence opt3 from hemagglutinin__InfluenzaA__ACZ96189

SEQ ID NO: 125851 - RNA, 1701 nt, Artificial Sequence; identical to SEQ ID NO: 125849
  derived and/or modified sequence opt3 from hemagglutinin__InfluenzaA__ACZ96199

SEQ ID NO: 125852 - RNA, 1701 nt, Artificial Sequence; identical to SEQ ID NO: 124685
  derived and/or modified sequence opt3 from hemagglutinin__InfluenzaA__ACZ96209

SEQ ID NO: 125853 - RNA, 1701 nt, Artificial Sequence
  derived and/or modified sequence opt3 from hemagglutinin__InfluenzaA__ACZ96219
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuaaauucgaggccacaggcaaccuagucguuccuagguacgcuuuugccauggaacggaacgcagggagcggaaucauaauuucggauacuccagugcaugacugcaauaccacaugucaaaccucuaagggcgcuaucaacacgucccucccguuccagaauauucaccccaucacuaucgguaagugcccuaaauauguaaagucaacaaaacugcgccuugccaccgggcugagaaacgugccaaguauucagagcaggggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauucaaauguaaagaaccuguacgagaaaguucgaagucagcucaagaacaaugcaaaggaaaucggcaacggauguuuugaguucuaucacaaaugcgacaauaccuguauggaauccgugaagaacggcacauacgauuaucccaaauacagcgaggaagccaagcugaauagagaggagauugcuggggucaaacuugaaucuacuaggaucuaucaaauucuggcgauauacucaaccguggcaaguagcuugguccucgugguuucccugggagccaucucuuuuuggaugugcucgaacgguagcuuacagugccggauuuguaucuga

SEQ ID NO: 125854 - RNA, 1701 nt, Artificial Sequence; identical to SEQ ID NO: 124685
  derived and/or modified sequence opt3 from hemagglutinin__InfluenzaA__ACZ96229

SEQ ID NO: 125855 - RNA, 1701 nt, Artificial Sequence; identical to SEQ ID NO: 125849
  derived and/or modified sequence opt3 from hemagglutinin__InfluenzaA__ACZ96239

SEQ ID NO: 125856 - RNA, 1701 nt, Artificial Sequence; identical to SEQ ID NO: 124685
  derived and/or modified sequence opt3 from hemagglutinin__InfluenzaA__ACZ96249

SEQ ID NO: 125857 - RNA, 1701 nt, Artificial Sequence
  derived and/or modified sequence opt3 from hemagglutinin__InfluenzaA__ACZ96269
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 125858 - RNA, 1701 nt, Artificial Sequence; identical to SEQ ID NO: 124685
  derived and/or modified sequence opt3 from hemagglutinin__InfluenzaA__ACZ96299

SEQ ID NO: 125859 - RNA, 1701 nt, Artificial Sequence; identical to SEQ ID NO: 124685
  derived and/or modified sequence opt3 from hemagglutinin__InfluenzaA__ACZ96309

SEQ ID NO: 125860 - RNA, 1701 nt, Artificial Sequence
  derived and/or modified sequence opt3 from hemagglutinin__InfluenzaA__ACZ96319
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguauaugcaacaucgccggcuggauucuggggaauccugagugugaaucuuugucaacagcaaguagcugguccuacaucguugagaccucuucgucagacaacggaacuugcuauccaggcgauuuuauugacuacgaggagcucagggagcagcugagcaguguguccucuuucgaacgguuugagaucuucccgaaaacaagcuccuggcccaaucacgauucaaacaagggugucaccgccgcuuguccucaugcaggggccaagaguuuuuauaaaaaucugauauggcucgugaagaaaggaaacagcuacccaaaguuaucuaaauccuauaucaaugacaagggcaaggaaguacugguucuuuggggcauucaccaccccucaacgagcgcugaucaacagaguuuguaccagaacgccgacgcguacguguucgucgggacuucucgcuauuccaaaaaguuuaaaccugagaucgcaauucgaccaaaggugcgugaucaggagggaagaaugaauuacuauuggacccugguggaacccggugacaaaaucacauucgaggccacuggcaaccuagucguuccuagguacgcuuuugccauggaacggaacgcagggagcggaauaauuaucucggauaccccagugcaugacugcaauacaaccugucaaacgccgaagggcgcuauuaacacuucucuccccuuccagaauauccacccuaucacaauugguaaaugcccaaaguauguaaaguccaccaaacugcgccuugccacugggcugagaaacgugcccucaauacagaguaggggauuguuuggcgcgaucgccggcuucauugaagggggauggacagguauggucgacggcugguacggguaucaucaccagaaugaacaaggaagcggcuacgcagcugaucucaaguccacccagaacgccaucgacgagauaacgaauaaagugaacucuguuauugagaagaugaauacccaguuuacagcuguggguaaagaguucaaccaccuggaaaagcggaucgaaaauuuaaacaagaaagucgaugacggguuccuggauaucuggacuuacaaugccgagcuccuugugcuguuggaaaacgagcgcacccuagacuaucaugauagcaauguaaagaaccuguacgagaaaguucgaucacagcucaagaacaaugcaaaagaaauuggcaacggauguuuugaguucuaucacaagugcgacaauacauguauggaaagugugaagaacggcacuuacgauuauccuaaauacuccgaggaagccaagcugaauagagaggagaucgacggggucaaacuugaaagcaccaggauuuaucaaauacuggcuaucuacucuacaguggcgucaaguuugguccucgugguuagccugggagcaauuuccuuuuggaugugcucuaacgguucguuacagugccggaucuguaucuga

SEQ ID NO: 125861 - RNA, 1701 nt, Artificial Sequence; identical to SEQ ID NO: 125860
  derived and/or modified sequence opt3 from hemagglutinin__InfluenzaA__ACZ96329

SEQ ID NO: 125862 - RNA, 1701 nt, Artificial Sequence
  derived and/or modified sequence opt3 from hemagglutinin__InfluenzaA__ACZ96339
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccggagggcgcaaucaacacuucccuccccuuccagaauauucacccuaucacaaucgguaaaugcccaaaguauguaaagucaaccaaacugcgccuugcuacugggcugagaaacgugcccaguauucagagcaggggauuguuuggcgccauagcgggcuucaucgaagggggauggacagguauggucgacggcugguacggguaucaucaccagaaugagcaaggauccggcuacgccgcagaucucaagucuacccagaacgcuauugacgagaucacgaauaaagugaacagcguuauaaagaaaaugaauacccaguuuacagccguggguaaggaguucaaccaccuggagaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 125863 - RNA, 1701 nt, Artificial Sequence; identical to SEQ ID NO: 124685
  derived and/or modified sequence opt3 from hemagglutinin__InfluenzaA__ACZ96349

SEQ ID NO: 125864 - RNA, 1701 nt, Artificial Sequence; identical to SEQ ID NO: 125860
  derived and/or modified sequence opt3 from hemagglutinin__InfluenzaA__ACZ96359

SEQ ID NO: 125865 - RNA, 1701 nt, Artificial Sequence; identical to SEQ ID NO: 124685
  derived and/or modified sequence opt3 from hemagglutinin__InfluenzaA__ACZ96372

SEQ ID NO: 125866 - RNA, 1701 nt, Artificial Sequence; identical to SEQ ID NO: 125860
  derived and/or modified sequence opt3 from hemagglutinin__InfluenzaA__ACZ96382

SEQ ID NO: 125867 - RNA, 1701 nt, Artificial Sequence; identical to SEQ ID NO: 124672
  derived and/or modified sequence opt3 from hemagglutinin__InfluenzaA__ACZ96392

SEQ ID NO: 125868 - RNA, 1701 nt, Artificial Sequence; identical to SEQ ID NO: 124927
  derived and/or modified sequence opt3 from hemagglutinin__InfluenzaA__ACZ96405

SEQ ID NO: 125869 - RNA, 1701 nt, Artificial Sequence; identical to SEQ ID NO: 124685
  derived and/or modified sequence opt3 from hemagglutinin__InfluenzaA__ACZ96415

SEQ ID NO: 125870 - RNA, 1701 nt, Artificial Sequence; identical to SEQ ID NO: 124685
  derived and/or modified sequence opt3 from hemagglutinin__InfluenzaA__ACZ96425

SEQ ID NO: 125871 - RNA, 1701 nt, Artificial Sequence
  derived and/or modified sequence opt3 from hemagglutinin__InfluenzaA__ACZ96435
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcucagcugcaucuugguaaaugcaacauagccggcuggauccuggggaaucccgagugugaaucuuugucaacagcaaguagcugguccuacauuguugagaccucuucgucagacaacggaacuugcuauccuggcgauuuuaucgacuacgaggagcucagggagcaacugagcaguguguccucuuucgaacgguuugagauuuucccaaagacaagcuccuggccgaaucacgauucaaacaagggugucaccgccgcuuguccccaugcaggggccaaaaguuuuuauaagaaucugaucuggcucgugaaaaagggaaacagcuacccuaaauuaucuaaguccuauauaaaugacaagggcaaagaaguacugguucuuuggggcauccaccacccaucaacgagcgcugaucagcagaguuuguaccagaacgccgacgcguacguguucgucgggacuucucgcuauuccaagaaauuuaagcccgagauugcaauccgaccuaaagugcgugaucaagagggaagaaugaauuacuauuggacccugguggaaccaggugacaagauuacauucgaggccacuggcaaccuaaugguccccagguacgcuuuugccauggaacggaacgcagggagcggaaucauaauuucggauaccccuguucaugacugcaauacaaccugucagacgccaaaaggcgcuaucaacacuucucucccguuccagaauauucaccccaucacaaucgguaagugcccuaaguaugugaaauccaccaagcugcgccuugccacugggcugagaaacguaccaucaauucagaguaggggauuguuuggcgcgauagccggcuucaucgaagggggauggacagguaugguggacggcugguacggguaucaucaccaaaaugaacagggaagcggcuacgcagcugaucucaaauccacccagaacgccauugacgagaucacgaauaaggucaacucugugauagagaaaaugaauacccaguuuacagcuguugguaaggaguucaaccaccuggaaaagcggauugaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacaacucaaaaacaaugcaaaggaaaucggcaacggauguuuugaguucuaucacaagugcgacaauacauguauggaaaguguuaaaaacggcacuuacgauuaucccaaguacuccgaggaagccaaacugaauagagaggagauugacggggugaaacuugaaagcaccaggaucuaucagauucuggcuauauacucuacagucgcgucaaguuuggugcucgucgugagccugggagcaaucuccuuuuggaugugcucuaacgguucguuacagugccggauuuguaucuga

SEQ ID NO: 125872 - RNA, 1701 nt, Artificial Sequence; identical to SEQ ID NO: 124685
  derived and/or modified sequence opt3 from hemagglutinin__InfluenzaA__ACZ96445

SEQ ID NO: 125873 - RNA, 1701 nt, Artificial Sequence
  derived and/or modified sequence opt3 from hemagglutinin__InfluenzaA__ACZ96476
augaaggccauccuggugguccuccuuuacaccuucgcuacagcauaugccgacacucugugcauuggcuaccacgcgaacaauagcacggauaccguugacacaguguuggagaagaacguaacugugacccauuccgucaauuuacuggaagauaagcacaacgggaaacuauguaagcucagaggaguggcuccccugcaucuugguaaaugcaauauagccggcuggauccuggggaacccugagugugaaucuuugucaacagcaaguagcugguccuauauuguugagaccucuucgucagacaauggaacuugcuacccaggcgauuuuaucgacuaugaggagcucagggagcagcugagcaguguguccucuuucgaacgguuugagauuuucccgaagacaagcuccuggcccaaccacgauucaaauaagggugucaccgccgcuuguccucaugcaggggccaaaaguuuuuacaagaaccugaucuggcucgugaaaaagggaaauagcuauccaaaauuaucuaaguccuacauaaacgacaagggcaaagaaguacugguucuuuggggcauccaccaccccucaacgagcgcugaucaacagaguuuguaccagaaugccgacgcguauguguucgucgggacuucucgcuacuccaagaaauuuaagccugagauugcaauccgaccaaaagugcgugaucaggagggaagaaugaacuauuacuggacccugguggaacccggugacaagauuacauucgaggccacuggcaaucuagucguuccuagguaugcuuuugccauggaacggaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguacguaaaauccaccaagcugcgccuugccacugggcugagaaaugugcccucaauucagaguaggggauuguuuggcgcgauagccggcuucaucgaagggggauggacagguauggucgacggcugguauggguaccaucaccagaacgaacaaggaagcggcuacgcagcugaucucaaauccacccagaaugccauugacgagaucacgaacaagguaaauucuguuauagagaaaaugaacacccaguuuacagcuguggguaaggaguucaaucaccuggaaaagcggauugaaaacuuaaauaaaaaggucgaugacggguuccuggauaucuggacuuauaacgccgagcuccuugugcuguuggaaaaugagcgcacccuagacuaccaugauagcaacgugaaaaaucuguaugagaagguucgaucacagcucaaaaacaacgcaaaggaaaucggcaauggauguuuugaguucuaccacaagugcgacaacacauguauggaaagugugaaaaauggcacuuaugauuacccuaaguauuccgaggaagccaaacugaacagagaggagauugacggggucaaacuugaaagcaccaggaucuaccaaauucuggcuauauacucuacaguggcgucaaguuugguccucgugguuagccugggagcaaucuccuuuuggaugugcucuaaugguucguuacagugccggauuuguaucuga

SEQ ID NO: 125874 - RNA, 1701 nt, Artificial Sequence; identical to SEQ ID NO: 124685
  derived and/or modified sequence opt3 from hemagglutinin__InfluenzaA__ACZ96496

SEQ ID NO: 125875 - RNA, 1701 nt, Artificial Sequence; identical to SEQ ID NO: 124685
  derived and/or modified sequence opt3 from hemagglutinin__InfluenzaA__ACZ96506

SEQ ID NO: 125876 - RNA, 1701 nt, Artificial Sequence; identical to SEQ ID NO: 124685
  derived and/or modified sequence opt3 from hemagglutinin__InfluenzaA__ACZ96526

SEQ ID NO: 125877 - RNA, 1701 nt, Artificial Sequence
  derived and/or modified sequence opt3 from hemagglutinin__InfluenzaA__ACZ96536
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaaaaggaguggcuccccuccaucuggguaagugcaacaucgccggcuggauucuugggaauccugagugugaaucucugucaacagcaaguagcugguccuacaucguugagaccucuucgucagacaacggaacuugcuauccaggcgauuuuauugacuacgaagaguugagagagcagcucagcaguguguccucuuucgaaagguuugagaucuucccgaagacaagcuccuggcccaaucacgauucaaacaaaggugucaccgccgcuuguccucaugcaggggccaagaguuuuuauaaaaaucugauauggcuggugaagaaaggaaacagcuacccaaagcucucuaaguccuauaucaaugacaaaggcaaggaaguauuaguucuguggggcauucaccaccccucaacgagcgcugaucaacagagucuuuaccagaacgccgacacuuacguguucgucgggucuuccaaauauagcaagaaauuuaagccugagaucgcgauucggccaaaagugcgcgaucaggagggacgaaugaauuacuauuggaccuugguggaacccggugacaagaucacauucgaggcaacuggcaaccuggucguuccucguuacgccuuugcuauggaaagaaacgccgggucgggaauaauuaucucugauaccccagugcaugacugcaauacaaccugucaaacgccgaagggcgcaauuaacacuucccuacccuuccagaauauccacccuaucacaauugguaaaugcccaaagcauguaaaaucaaccaagcucaggcuggcuacugggcuucggaacgugcccaguauacagagccgcggacuguuuggcgccaucgcgggcuucauugaagggggauggacagguauggucgacggcugguauggguaccaccaccagaaugaacaaggauccggcuaugccgcagauuugaaaucuacccagaacgcuaucgacgagauaacgaauaaggugaacagcguuauugagaagaugaauacccaguuuacagccguggguaaagaguucaaccaucucgagaagagaaucgaaaaucugaacaaaaaggucgaugacggguucuuagauaucuggacuuacaaugcugagcugcucgugcuucuggaaaacgagaggaccuuggacuaccacgauucaaauguuaaaaaccuauaugagaagguacggagucagcugaagaacaaugccaaagaaauuggcaacggauguuuugaguucuaccauaagugcgacaauacauguauggaauccgugaaaaacggcacuuaugauuacccuaaguauagcgaggaagcaaaacucaaucgcgaggagaucgacggggucaagcuggaaucuacccgaauuuaccaaauacuugccaucuauucaacaguggcuaguagccuggucuuggugguuucccucggagcgauuucuuuuuggaugugcucgaacgguagccugcagugcagaaucuguaucuga

SEQ ID NO: 125878 - RNA, 1701 nt, Artificial Sequence; identical to SEQ ID NO: 124685
  derived and/or modified sequence opt3 from hemagglutinin__InfluenzaA__ACZ96549

SEQ ID NO: 125879 - RNA, 1701 nt, Artificial Sequence
  derived and/or modified sequence opt3 from hemagglutinin__InfluenzaA__ACZ96559
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125880 - RNA, 1701 nt, Artificial Sequence
  derived and/or modified sequence opt3 from hemagglutinin__InfluenzaA__ACZ96569
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucaauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggucuucccgcuauagcaaaaaguuuaaaccugagauugcaauccgaccaaaggugcgugaccaggaaggaagaaugaacuacuauuggacucugguggagcccggugauaaaauuaccuucgaagccacaggcaaccuagucguuccuagguacgcuuuugccauggagcggaaugcagggucgggaaucauaauuucugacacuccagugcaugauugcaacaccacaugucaaaccccgaagggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgacggcugguacggguaucaccaccagaacgagcagggauccggcuacgcagcugaccucaagucuacacaaaaugccauugaugagaucaccaacaaagugaauagcguuauagaaaagaugaacacgcaguuuaccgcuguggguaaagaguucaaucaucuggaaaagcggauugagaacuuaaauaagaaagucgacgauggguuccuggacaucuggacauacaacgccgaacuccuugugcuguuggagaaugagcgcacucuagauuaucacgacucaaacguaaagaaccuguacgaaaaaguucgaagucagcucaagaauaacgcaaaagagaucggcaauggauguuuugaguucuaucauaagugcgauaacaccuguauggaauccgugaagaauggcacauacgacuauccuaaauacagcgaagaggccaagcugaacagagaggaaauugauggggucaaacuugagucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 125881 - RNA, 1701 nt, Artificial Sequence
  derived and/or modified sequence opt3 from hemagglutinin__InfluenzaA__ACZ96579
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaagcagugcugaucaacagucuuuguaccagaacgccgacgcguacguguucgucggguccagccgcuauucgaaaaaguuuaaaccugagauugcaauccgaccaaaggugcgugaucaggaaggaagaaugaauuacuauuggacgcugguggagcccggugacaaaauuacuuucgaagccaccggcaaccuagucguuccuagguacgcuuuugccauggagcggaacgcagggucuggaaucauaauuuccgauacaccagugcaugacugcaauacuaccugucaaacaccgaagggcgcuaucaacaccucacuccccuuccacaauauucauccuaucacgaucgguaaaugcccaaaguauguaaagaguacuaaacugcgccuugccacagggcugagaaacgugcccagcauucaguccaggggauuguuuggcgcgauagccggcuucaucgaagggggauggaccgguauggucgacggcugguacggguaucaccaccagaaugagcagggaucuggcuacgcagcugaucucaagagcacucaaaacgccauugacgagaucacaaauaaagugaacucaguuauagaaaagaugaauacccaguuuacggcuguggguaaagaguucaaccaucuggaaaagcggauugagaauuuaaacaagaaagucgaugacggguuccuggauaucuggaccuacaaugccgaacuccuugugcuguuggagaacgagcgcacacuagacuaucacgauaguaauguaaagaaccuguacgaaaaaguucgaucccagcucaagaacaaugcaaaagagaucggcaacggauguuuugaguucuaucauaagugcgacaauacuuguauggaaagcgugaagaacggcaccuacgauuauccuaaauacucugaagaggccaagcugaauagagaggaaauugacggggucaaacuugagucaacaaggaucuaucagauucuggcuauauacaguacuguggcgagcuccuugguccucgugguuucucugggagcaaucucguuuuggaugugcagcaacgguuccuuacaaugccggauuuguaucuga

SEQ ID NO: 125882 - RNA, 1701 nt, Artificial Sequence; identical to SEQ ID NO: 124685
  derived and/or modified sequence opt3 from hemagglutinin__InfluenzaA__ACZ96589

SEQ ID NO: 125883 - RNA, 1701 nt, Artificial Sequence
  derived and/or modified sequence opt3 from hemagglutinin__InfluenzaA__ACZ96599
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacaccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagaaaagaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaguccgugaaaaacggcaccuacgacuaucccaaguacagcgaagaggcaaaacugaauagagaggaaauugauggggucaaacuugagucuacaaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 125884 - RNA, 1701 nt, Artificial Sequence
  derived and/or modified sequence opt3 from hemagglutinin__InfluenzaA__ACZ96609
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugaccaggagggaagaaugaacuacuauuggacucugguggaacccggugauaagauuaccuucgaggccacaggcaaccuagucguuccuagguacgcuuuugccauggaacggaaugcagggucgggaaucauaauuucugacacuccagugcaugauugcaacaccacaugucaaaccccgaaaggcgcuaucaauacgucccuccccuuccagaacauucacccuaucacuaucgguacaugcccaaaguauguaaagucaaccaaacugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaccucaagucuacccagaaugccauugaugagaucacgaacaaagugaauagcguuauagagaagaugaacacccaguuuacagcuguggguaaagaguucaaucaccuggaaaagcggauugaaaacuuaaauaagaaagucgacgauggguuccuggacaucuggacuuacaacgccgagcuccuugugcuguuggaaaaugagcgcacccuagauuaucaugacucaaacguaaagaaccuguacgagaaaguucgaagucagcucaagaauaacgcaaaagaaaucggcaauggauguuuugaguucuaucacaagugcgauaacacauguauggaauccgugaagaauggcacuuacgacuauccuaaauacagcgaggaagccaagcugaacagagaggagauugauggggucaaacuugaaucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 125885 - RNA, 1701 nt, Artificial Sequence; identical to SEQ ID NO: 124865
  derived and/or modified sequence opt3 from hemagglutinin__InfluenzaA__ACZ96619

SEQ ID NO: 125886 - RNA, 1701 nt, Artificial Sequence; identical to SEQ ID NO: 124865
  derived and/or modified sequence opt3 from hemagglutinin__InfluenzaA__ACZ96629

SEQ ID NO: 125887 - RNA, 1701 nt, Artificial Sequence; identical to SEQ ID NO: 124865
  derived and/or modified sequence opt3 from hemagglutinin__InfluenzaA__ACZ96639

SEQ ID NO: 125888 - RNA, 1701 nt, Artificial Sequence; identical to SEQ ID NO: 124865
  derived and/or modified sequence opt3 from hemagglutinin__InfluenzaA__ACZ96649

SEQ ID NO: 125889 - RNA, 1701 nt, Artificial Sequence; identical to SEQ ID NO: 124865
  derived and/or modified sequence opt3 from hemagglutinin__InfluenzaA__ACZ96659

SEQ ID NO: 125890 - RNA, 1701 nt, Artificial Sequence; identical to SEQ ID NO: 124865
  derived and/or modified sequence opt3 from hemagglutinin__InfluenzaA__ACZ96669

SEQ ID NO: 125891 - RNA, 1701 nt, Artificial Sequence; identical to SEQ ID NO: 124865
  derived and/or modified sequence opt3 from hemagglutinin__InfluenzaA__ACZ96679

SEQ ID NO: 125892 - RNA, 1701 nt, Artificial Sequence; identical to SEQ ID NO: 124865
  derived and/or modified sequence opt3 from hemagglutinin__InfluenzaA__ACZ96689

SEQ ID NO: 125893 - RNA, 1701 nt, Artificial Sequence; identical to SEQ ID NO: 124865
  derived and/or modified sequence opt3 from hemagglutinin__InfluenzaA__ACZ96699

SEQ ID NO: 125894 - RNA, 1701 nt, Artificial Sequence; identical to SEQ ID NO: 124865
  derived and/or modified sequence opt3 from hemagglutinin__InfluenzaA__ACZ96719

SEQ ID NO: 125895 - RNA, 1701 nt, Artificial Sequence; identical to SEQ ID NO: 124865
  derived and/or modified sequence opt3 from hemagglutinin__InfluenzaA__ACZ96729

SEQ ID NO: 125896 - RNA, 1701 nt, Artificial Sequence; identical to SEQ ID NO: 124865
  derived and/or modified sequence opt3 from hemagglutinin__InfluenzaA__ACZ96739

SEQ ID NO: 125897 - RNA, 1701 nt, Artificial Sequence
  derived and/or modified sequence opt3 from hemagglutinin__InfluenzaA__ACZ96749
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggucuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 125898 - RNA, 1701 nt, Artificial Sequence; identical to SEQ ID NO: 124672
  derived and/or modified sequence opt3 from hemagglutinin__InfluenzaA__ACZ96759

SEQ ID NO: 125899 - RNA, 1701 nt, Artificial Sequence; identical to SEQ ID NO: 124672
  derived and/or modified sequence opt3 from hemagglutinin__InfluenzaA__ACZ96769

SEQ ID NO: 125900 - RNA, 1701 nt, Artificial Sequence; identical to SEQ ID NO: 124672
  derived and/or modified sequence opt3 from hemagglutinin__InfluenzaA__ACZ96779

SEQ ID NO: 125901 - RNA, 1701 nt, Artificial Sequence; identical to SEQ ID NO: 124672
  derived and/or modified sequence opt3 from hemagglutinin__InfluenzaA__ACZ96789

SEQ ID NO: 125902 - RNA, 1701 nt, Artificial Sequence
  derived and/or modified sequence opt3 from hemagglutinin__InfluenzaA__ACZ96809
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgaacgcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuugcugccguggguaaggaguucaaucaccuggaaaagcggauugaaaacuuaaauaaaaaggucgaugacggguuccuggauaucuggacauacaacgcagagcuccuugugcuguuggaaaaugagcgcacucuagacuaucaugauucuaacguaaagaaccuguacgagaagguucgaagccagcucaaaaauaacgccaaggaaaucggcaauggauguuuugaguucuaucacaagugcgacaacaccuguauggaaucagugaaaaauggcacauacgauuauccuaaguacagugaggaagcuaaacugaacagagaggagauugacggggucaaacuugaauccacuaggaucuaucaaauucuggcgauauacagcaccguggcaucuucauugguccucgugguuagucugggagccaucagcuuuuggaugugcuccaaugguucuuuacagugccggauuuguaucuga

SEQ ID NO: 125903 - RNA, 1701 nt, Artificial Sequence; identical to SEQ ID NO: 124672
  derived and/or modified sequence opt3 from hemagglutinin__InfluenzaA__ACZ96819

SEQ ID NO: 125904 - RNA, 1701 nt, Artificial Sequence; identical to SEQ ID NO: 124672
  derived and/or modified sequence opt3 from hemagglutinin__InfluenzaA__ACZ96829

SEQ ID NO: 125905 - RNA, 1701 nt, Artificial Sequence; identical to SEQ ID NO: 124672
  derived and/or modified sequence opt3 from hemagglutinin__InfluenzaA__ACZ96839

SEQ ID NO: 125906 - RNA, 1701 nt, Artificial Sequence; identical to SEQ ID NO: 125825
  derived and/or modified sequence opt3 from hemagglutinin__InfluenzaA__ACZ96849

SEQ ID NO: 125907 - RNA, 1701 nt, Artificial Sequence; identical to SEQ ID NO: 124685
  derived and/or modified sequence opt3 from hemagglutinin__InfluenzaA__ACZ96859

SEQ ID NO: 125908 - RNA, 1701 nt, Artificial Sequence; identical to SEQ ID NO: 124672
  derived and/or modified sequence opt3 from hemagglutinin__InfluenzaA__ACZ96869

SEQ ID NO: 125909 - RNA, 1701 nt, Artificial Sequence; identical to SEQ ID NO: 124672
  derived and/or modified sequence opt3 from hemagglutinin__InfluenzaA__ACZ96879

SEQ ID NO: 125910 - RNA, 1701 nt, Artificial Sequence
  derived and/or modified sequence opt3 from hemagglutinin__InfluenzaA__ACZ96899
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccacucaagcacgagugcugaucaacagucuuuguaccagaacgccgacgcguacguguucgucggguccagccgcuauucgaagaaauuuaagcccgagauugcaauccgaccuaaagugcgugaucaggagggaagaaugaauuacuauuggacucugguggaaccaggugacaagauuaccuucgaggccacaggcaaccuagucguucccagguacgcuuuugccauggaacggaacgcagggucuggaaucauaauuuccgauacuccugugcaugacugcaauaccacaugucaaaccccaaaaggcgcuaucaacacgucacucccguuccagaauauucaccccaucacuaucgguaagugcccuaaguauguaaaaaguacaaagcugcgccuugccaccgggcugagaaacgugccaagcauucaguccaggggauuguuuggcgcgauagccggcuucaucgaagggggauggacugguauggucgacggcugguacggguaucaucaccagaaugaacaaggaucuggcuacgcagcugaucucaaaagcacacagaacgccauugacgagaucaccaauaaggugaacucaguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauaguaauguaaagaaccuguacgagaagguucgaucccagcucaaaaacaaugcaaaggaaaucggcaacggauguuuugaguucuaucacaagugcgacaauaccuguauggaaagcgugaaaaacggcacauacgauuaucccaaguacucugaggaagccaaacugaauagagaggagauugacggggucaaacuugaaucaacuaggaucuaucaaauucuggcuauauacaguaccguggcgagcuccuugguccucgugguuucucugggagcaaucucguuuuggaugugcagcaacgguuccuuacagugccggauuuguaucuga

SEQ ID NO: 125911 - RNA, 1701 nt, Artificial Sequence; identical to SEQ ID NO: 124672
  derived and/or modified sequence opt3 from hemagglutinin__InfluenzaA__ACZ96909

SEQ ID NO: 125912 - RNA, 1701 nt, Artificial Sequence; identical to SEQ ID NO: 124672
  derived and/or modified sequence opt3 from hemagglutinin__InfluenzaA__ACZ96919

SEQ ID NO: 125913 - RNA, 1701 nt, Artificial Sequence; identical to SEQ ID NO: 124672
  derived and/or modified sequence opt3 from hemagglutinin__InfluenzaA__ACZ96929

SEQ ID NO: 125914 - RNA, 1701 nt, Artificial Sequence; identical to SEQ ID NO: 124672
  derived and/or modified sequence opt3 from hemagglutinin__InfluenzaA__ACZ96939

SEQ ID NO: 125915 - RNA, 1701 nt, Artificial Sequence
  derived and/or modified sequence opt3 from hemagglutinin__InfluenzaA__ACZ96949
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagaugcucgugcuucuggaaaacgagcgcacuuuggacuaucaugauucaaauguuaaaaaccuauacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacucaauagagaggagauugacggggucaagcuggaaucuacuaggaucuaucaaauucuugcuauauacucaaccguggcgaguagccuggucuuggugguuucccucggagcaaucucuuuuuggaugugcucgaacgguagccugcagugccggauuuguaucuga

SEQ ID NO: 125916 - RNA, 1701 nt, Artificial Sequence; identical to SEQ ID NO: 124672
  derived and/or modified sequence opt3 from hemagglutinin__InfluenzaA__ACZ97021

SEQ ID NO: 125917 - RNA, 1701 nt, Artificial Sequence; identical to SEQ ID NO: 125039
  derived and/or modified sequence opt3 from hemagglutinin__InfluenzaA__ACZ97343

SEQ ID NO: 125918 - RNA, 1701 nt, Artificial Sequence; identical to SEQ ID NO: 125039
  derived and/or modified sequence opt3 from hemagglutinin__InfluenzaA__ACZ97353

SEQ ID NO: 125919 - RNA, 1701 nt, Artificial Sequence; identical to SEQ ID NO: 124672
  derived and/or modified sequence opt3 from hemagglutinin__InfluenzaA__ACZ97363

SEQ ID NO: 125920 - RNA, 1701 nt, Artificial Sequence
  derived and/or modified sequence opt3 from hemagglutinin__InfluenzaA__ACZ97383
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuacuucggacaacggaacaugcuauccaggcgauuuuaucgacuacgaggagcucagggagcagcugucaagcgugaguuccuucgaacgguuugagauuuucccgaagaccucuagcuggcccaaucacgauuccaacaagggugucacggccgcuuguccucaugcaggggccaaaucauuuuauaagaaucugaucuggcucgugaaaaagggaaacaguuacccaaaauuaagcaagucuuauauaaaugacaagggcaaagaaguacugguucuuuggggcauccaccaccccuccacuucagcugaucaacagagcuuguaccagaacgccgacgcguacguguucgucgggaguucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125921 - RNA, 1701 nt, Artificial Sequence; identical to SEQ ID NO: 124672
  derived and/or modified sequence opt3 from hemagglutinin__InfluenzaA__ACZ97393

SEQ ID NO: 125922 - RNA, 1701 nt, Artificial Sequence
  derived and/or modified sequence opt3 from hemagglutinin__InfluenzaA__ACZ98178
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacuacgggaaacuauguaagcucagaggaguggcuccccugcaucuugguaaaugcaauauagccggcuggauccuggggaacccugagugugaaucuuugucaacagcaaguagcugguccuauauuguugagaccucuucgucagacaauggaacuugcuacccaggcgauuuuaucgacuaugaggagcucagggagcagcugagcaguguguccucuuucgaacgguuugagauuuucccgaagacaagcuccuggcccaaccacgauucaaauaagggugucaccacggccuguccucaugcuggggcaaaaaguuuuuacaagaaccugaucuggcucgugaaaaagggaaauagcuauccaaaauuaucuaaguccuacauaaacgacaagggcaaagaaguacugguucuuuggggcauccaccaccccucaacuagcgccgaucaacagaguuuguaccagaaugcugacgccuauguguucgucgggaccucucgcuacuccaagaaauuuaagccugagauugcgauccgaccaaaagugcgugaucaggagggaagaaugaacuauuacuggacacugguggaacccggugacaagauuacuuucgaggcaaccggcaaucuagucguuccuagguaugccuuugcuauggaacggaacgccgggagcggaaucauaauuucggauacaccagugcaugacugcaacaccacgugucaaacuccgaaaggcgcaaucaauacaucucuccccuuccagaacauucacccuaucaccaucgguaagugcccaaaguacguaaaauccacuaagcugcgccuugcuacagggcugagaaaugugcccucaauucagaguaggggauuguuuggcgccauagcgggcuucaucgaagggggauggaccgguauggucgacggcugguauggguaccaucaccagaacgaacaaggaagcggcuacgccgcagaucucaaauccacgcagaaugcuauugacgagaucaccaacaagguaaauucuguuauagagaaaaugaacacacaguuuacugccguggguaaggaguucaaucaccuggaaaagcggauugaaaacuuaaauaaaaaggucgaugacggguuccuggauaucuggaccuauaacgcugagcuccuugugcuguuggaaaaugagcgcacacuagacuaccaugauagcaacgugaaaaaucuguaugagaagguucgaucacagcucaaaaacaacgccaaggaaaucggcaauggauguuuugaguucuaccacaagugcgacaacacuuguauggaaagugugaaaaauggcaccuaugauuacccuaaguauuccgaggaagcaaaacugaacagagaggagauugacggggucaaacuugaaagcacaaggaucuaccaaauucuggccauauacucuaccguggcuucaaguuugguccucgugguuagccugggagcgaucuccuuuuggaugugcucuaaugguucguuacagugccggauuuguaucuga

SEQ ID NO: 125923 - RNA, 1701 nt, Artificial Sequence; identical to SEQ ID NO: 124672
  derived and/or modified sequence opt3 from hemagglutinin__InfluenzaA__ACZ98188

SEQ ID NO: 125924 - RNA, 1701 nt, Artificial Sequence; identical to SEQ ID NO: 124865
  derived and/or modified sequence opt3 from hemagglutinin__InfluenzaA__ACZ98198

SEQ ID NO: 125925 - RNA, 1701 nt, Artificial Sequence; identical to SEQ ID NO: 124685
  derived and/or modified sequence opt3 from hemagglutinin__InfluenzaA__ACZ98208

SEQ ID NO: 125926 - RNA, 1701 nt, Artificial Sequence; identical to SEQ ID NO: 124685
  derived and/or modified sequence opt3 from hemagglutinin__InfluenzaA__ACZ98218

SEQ ID NO: 125927 - RNA, 1701 nt, Artificial Sequence; identical to SEQ ID NO: 124685
  derived and/or modified sequence opt3 from hemagglutinin__InfluenzaA__ACZ98228

SEQ ID NO: 125928 - RNA, 1701 nt, Artificial Sequence; identical to SEQ ID NO: 124685
  derived and/or modified sequence opt3 from hemagglutinin__InfluenzaA__ACZ98238

SEQ ID NO: 125929 - RNA, 1701 nt, Artificial Sequence; identical to SEQ ID NO: 125314
  derived and/or modified sequence opt3 from hemagglutinin__InfluenzaA__ACZ98248

SEQ ID NO: 125930 - RNA, 1701 nt, Artificial Sequence; identical to SEQ ID NO: 124685
  derived and/or modified sequence opt3 from hemagglutinin__InfluenzaA__ACZ98258

SEQ ID NO: 125931 - RNA, 1701 nt, Artificial Sequence; identical to SEQ ID NO: 124685
  derived and/or modified sequence opt3 from hemagglutinin__InfluenzaA__ACZ98268

SEQ ID NO: 125932 - RNA, 1701 nt, Artificial Sequence; identical to SEQ ID NO: 125825
  derived and/or modified sequence opt3 from hemagglutinin__InfluenzaA__ACZ98278

SEQ ID NO: 125933 - RNA, 1701 nt, Artificial Sequence; identical to SEQ ID NO: 125825
  derived and/or modified sequence opt3 from hemagglutinin__InfluenzaA__ACZ98288

SEQ ID NO: 125934 - RNA, 1701 nt, Artificial Sequence
  derived and/or modified sequence opt3 from hemagglutinin__InfluenzaA__ACZ98298
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggucuucccgguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgguaucaccaauaaagugaacagcguuauagagaagaugaauacgcaguuuaccgcuguggggaaggaguucaaccaccuggagaaaaggauugagaauuuaaacaagaaagucgaugacggcuuccuggauaucuggacauacaaugccgaacuccuugugcuguuggagaacgaacggacucuagacuaucaugauucaaauguaaagaaccuguacgagaaaguucgcagucagcucaagaacaaugcaaaggagaucggaaacggcuguuuugaguucuaucacaaaugcgacaauaccuguauggaguccgugaagaacgggacauacgauuauccuaaauacagcgaagaggccaagcugaaucgagaagagauugacggagucaaacuugagucuacuagaaucuaucaaauucuggcuauauacucaaccguggcgaguagcuugguccucgugguuucccugggugcaaucucuuuuuggaugugcucgaacggcagcuuacagugcaggauuuguaucuga

SEQ ID NO: 125935 - RNA, 1701 nt, Artificial Sequence
  derived and/or modified sequence opt3 from hemagglutinin__InfluenzaA__ACZ98318
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucauauucuggcuauauacucuacaguggcgucaaguuugguccucgugguuagccugggagcaaucuccuuuuggaugugcucuaacgguucguuacaaugccggauuuguaucuga

SEQ ID NO: 125936 - RNA, 1701 nt, Artificial Sequence; identical to SEQ ID NO: 124927
  derived and/or modified sequence opt3 from hemagglutinin__InfluenzaA__ACZ98328

SEQ ID NO: 125937 - RNA, 1701 nt, Artificial Sequence; identical to SEQ ID NO: 124685
  derived and/or modified sequence opt3 from hemagglutinin__InfluenzaA__ACZ98338

SEQ ID NO: 125938 - RNA, 1701 nt, Artificial Sequence; identical to SEQ ID NO: 125825
  derived and/or modified sequence opt3 from hemagglutinin__InfluenzaA__ACZ98348

SEQ ID NO: 125939 - RNA, 1701 nt, Artificial Sequence; identical to SEQ ID NO: 124685
  derived and/or modified sequence opt3 from hemagglutinin__InfluenzaA__ACZ98358

SEQ ID NO: 125940 - RNA, 1701 nt, Artificial Sequence; identical to SEQ ID NO: 124685
  derived and/or modified sequence opt3 from hemagglutinin__InfluenzaA__ACZ98368

SEQ ID NO: 125941 - RNA, 1701 nt, Artificial Sequence; identical to SEQ ID NO: 124927
  derived and/or modified sequence opt3 from hemagglutinin__InfluenzaA__ACZ98388

SEQ ID NO: 125942 - RNA, 1701 nt, Artificial Sequence; identical to SEQ ID NO: 124685
  derived and/or modified sequence opt3 from hemagglutinin__InfluenzaA__ACZ98398

SEQ ID NO: 125943 - RNA, 1701 nt, Artificial Sequence; identical to SEQ ID NO: 124685
  derived and/or modified sequence opt3 from hemagglutinin__InfluenzaA__ACZ98408

SEQ ID NO: 125944 - RNA, 1701 nt, Artificial Sequence; identical to SEQ ID NO: 124865
  derived and/or modified sequence opt3 from hemagglutinin__InfluenzaA__ACZ98418

SEQ ID NO: 125945 - RNA, 1701 nt, Artificial Sequence; identical to SEQ ID NO: 124685
  derived and/or modified sequence opt3 from hemagglutinin__InfluenzaA__ACZ98428

SEQ ID NO: 125946 - RNA, 1701 nt, Artificial Sequence; identical to SEQ ID NO: 124685
  derived and/or modified sequence opt3 from hemagglutinin__InfluenzaA__ACZ98438

SEQ ID NO: 125947 - RNA, 1701 nt, Artificial Sequence; identical to SEQ ID NO: 124685
  derived and/or modified sequence opt3 from hemagglutinin__InfluenzaA__ACZ98448

SEQ ID NO: 125948 - RNA, 1701 nt, Artificial Sequence; identical to SEQ ID NO: 125825
  derived and/or modified sequence opt3 from hemagglutinin__InfluenzaA__ACZ98458

SEQ ID NO: 125949 - RNA, 1701 nt, Artificial Sequence
  derived and/or modified sequence opt3 from hemagglutinin__InfluenzaA__ACZ98546
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuuacuacagggcugagaaacgugccuuccauucaguacaggggauuguuuggcgccauaaccggcuucaucgaagggggauggacggguauggucgacggcugguauggguaccaucaccagaaugaacaaggaucaggcuacgcggccgaucucaaaaguacccagaacgcaauugacgagaucacaaauaaggugaacagcguuauagagaaaaugaauacucaguuuaccgcuguggguaaggaguucaaccaccuggaaaagcggauugaaaauuuaaacaaaaaggucgaugacggguuccuggauaucuggacauauaaugccgagcuccuugugcuguuggaaaacgagcgcacucuagacuaccaugauuccaauguaaagaaccuguaugagaagguucgaucucagcucaaaaacaaugcuaaggaaaucggcaacggauguuuugaguucuaccacaagugcgacaauaccuguauggaaagcgugaaaaacggcacauaugauuacccaaaguauucagaggaagccaaacugaauagagaggagauugacggggucaaacuugaaaguaccaggaucuaccaaauucuggcaauauacuccacuguggccagcucuuugguccucgugguuucacugggagcuaucaguuuuuggaugugcagcaacgguuccuuacagugccggauuuguaucuga

SEQ ID NO: 125950 - RNA, 1701 nt, Artificial Sequence
  derived and/or modified sequence opt3 from hemagglutinin__InfluenzaA__ACZ98560
augaaggccaucagagugguccugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaaggggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugcgggagcagcucagcaguguguccucuuucgaacgcuuugagauuuucccgaagacaagcuccuggcccaaucacgauccuaacaagggugucaccgccgcuuguccacaugcaggggccaaaucauuuuauaagaaucugaucuggcuggugaaaaagggaaacaguuaccccaaacucagcaagucuuauauaaaugacaagggcaaagaaguauuaguucuguggggcauccaccacccuuccacgucagcugaucaacagagccuuuaccagaacgccgacgcguacguguucgucgggaccagucgauauucuaagaaauuuaagccagagauugcaauccgucccaaagugagagaucaggagggaaggaugaauuacuauuggacuuugguggaaccuggugacaagauuacauucgaggccacuggcaaccuggucguuccacgguacgcuuuugccauggaacgcaacgcaggguccggaaucauaauuagcgauaccccggugcaugacugcaauacaaccugucaaacgcccaaaggcgcuaucaacacuucgcuaccuuuccagaauauucacccaaucacaaucgguaagugccccaaguauguaaaaucuccuaagcucagacuggccaccgggaugaggaacgugccauuuauucaguaccggggacuuuucggcgcgauaacuggcuuuaucgaagggggauggacagguauggucgacggcugguauggguaccaucaccagaaugaacaaggauccggcuacgccgcagaucugaaaucaacccagaacgcuauugacgagaucacgaauaaggugaacaguguuauagagaaaaugaauacccaguucacagccguggguaaggaguucaaccacuuggagaagcgcauugaaaaucucaacaaaaaggucgaugacggguuucuggauaucuggacuuauaaugcugaguuacuggugcuccuugaaaacgagcgaacccuggacuaccaugauagcaauguuaaaaacuuguaugagaagguaagaucccagcugaaaaacaaugccaaggaaaucggcaacggauguuucgaguuuuaccacaagugcgacaauacauguauggaaucugugaaaaacggcacuuaugauuaccccaaguauagcgaggaagcaaaacuaaauagggaggagauugacggggucaagcucgaaucaacccggaucuaccaaauucuggccauauacaguacaguggcuuccagccuuguccuggugguuucuuugggagcgaucucauucuggaugugcaguaacgguagccuccagugccguauuuguaucuga

SEQ ID NO: 125951 - RNA, 1701 nt, Artificial Sequence
  derived and/or modified sequence opt3 from hemagglutinin__InfluenzaA__ACZ98567
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuccuaagcugcgccuugccuccgggaugagaaacgugccauuuauucagucaaggggacuguucggcgcgauaaccggcuuuaucgaggaaggguggacuggaauggucgacgguugguacggcuuccaucaccagaaugagcaagggaguggauaugccgcagauuugaaaagcacacagaacgcuauugacgagaucaccaauaaggugaacuccguuauagagaaaaugaauacgcaguucaccgccgugggcaaggaguuuaaccaccucgaaaagcggauugagaaucugaacaaaaaggucgaugacgguuucuuagauaucuggacauacaaugcugaacugcucgugcuucuggagaacgagcgcacuuuggacuaccaugauucuaauguuaaaaaccuauaugaaaagguacgaagccagcugaaaaacaaugccaaggagaucgggaacggcuguuuugaguucuaccacaagugcgacaauaccuguauggaaucagugaaaaacggaacauaugauuaccccaaguauagugaagaggcaaaacucaauagagaggaaauugacggcgucaagcuggaguccacuaggaucuaccaaauucuugccauauauagcaccguggcuucuucacuggucuuggugguuagucucggggcgaucagcuuuuggaugugcuccaacggaucucugcagugccggauuuguaucuga

SEQ ID NO: 125952 - RNA, 1701 nt, Artificial Sequence; identical to SEQ ID NO: 124672
  derived and/or modified sequence opt3 from hemagglutinin__InfluenzaA__ACZ98671

SEQ ID NO: 125953 - RNA, 1701 nt, Artificial Sequence; identical to SEQ ID NO: 124672
  derived and/or modified sequence opt3 from hemagglutinin__InfluenzaA__ACZ98681

SEQ ID NO: 125954 - RNA, 1701 nt, Artificial Sequence; identical to SEQ ID NO: 124685
  derived and/or modified sequence opt3 from hemagglutinin__InfluenzaA__ACZ98691

SEQ ID NO: 125955 - RNA, 1701 nt, Artificial Sequence
  derived and/or modified sequence opt3 from hemagglutinin__InfluenzaA__ADA60799
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacauucccucaauacagagucggggauuguuuggcgcgaucgccggcuucauugaagggggauggacagguaugguggacggcugguacggguaucaucaccagaaugaacaaggaagcggcuacgcagcugaucucaaguccacccagaacgccaucgacgagauaacgaauaaagucaacucugugauugagaagaugaauacccaguuuacagcuguugguaaagaguucaaccaccuggaaaagcgcaucgaaaauuuaaacaagaaaguggaugacggguuccuggauaucuggacuuacaaugccgagcuccuuguccuguuggaaaacgagcgaacccuagacuaucaugauagcaaugugaagaaccuguacgagaaaguaagaucacagcucaagaacaaugcaaaagaaauuggcaacggauguuuugaguucuaucacaagugcgacaauacauguauggaaaguguuaagaacggcacuuacgauuauccuaaauacuccgaggaagccaagcugaauagggaggagaucgacggggugaaacuugaaagcacccggauuuaucaaauacuggcuaucuacucuacagucgcgucaaguuuggugcucgucgugagccugggagcaauuuccuuuuggaugugcucuaacgguucguuacagugccguaucuguaucuga

SEQ ID NO: 125956 - RNA, 1701 nt, Artificial Sequence; identical to SEQ ID NO: 125849
  derived and/or modified sequence opt3 from hemagglutinin__InfluenzaA__ADA69302

SEQ ID NO: 125957 - RNA, 1701 nt, Artificial Sequence; identical to SEQ ID NO: 125849
  derived and/or modified sequence opt3 from hemagglutinin__InfluenzaA__ADA69312

SEQ ID NO: 125958 - RNA, 1701 nt, Artificial Sequence; identical to SEQ ID NO: 125849
  derived and/or modified sequence opt3 from hemagglutinin__InfluenzaA__ADA69322

SEQ ID NO: 125959 - RNA, 1701 nt, Artificial Sequence; identical to SEQ ID NO: 125849
  derived and/or modified sequence opt3 from hemagglutinin__InfluenzaA__ADA69332

SEQ ID NO: 125960 - RNA, 1701 nt, Artificial Sequence; identical to SEQ ID NO: 125786
  derived and/or modified sequence opt3 from hemagglutinin__InfluenzaA__ADA70329

SEQ ID NO: 125961 - RNA, 1698 nt, Artificial Sequence
  derived and/or modified sequence opt3 from hemagglutinin__InfluenzaA__ADA71150
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuaguggaaaacucucacaaugggaaacugugccuacucaagggaauagcgccccugcagcuugguaacuguucaguugccggcuggauccuggggaauccugagugcgaauugcucauuaguaaagagagcugguccuacaucguggaaaagccaaacccggagaauggaaccuguuaucccggccauuuugcugauuacgaggaacugagagagcaacugucuucggucagcucauucgaaagguuugagauuuucccuaaggagaguuccuggccaaaccacacugugacagguguaucugccagcugcucccauaauggggaaucaaguuuuuaucggaaccucuuauggcugaccggaaagaauggccuuuaccccaacuugagcaagucuuaugcaaauaacaaagagaaggaaguucuggugcuauggggcguccaccacccuccauccaucucaaaccagaaaacgcucuaccauacugagaaugccuacgugagcguggucaguucucacuauucccgcaaguucacccccgaaauagcuaagcgaccuaaaguucgugaccaggaggggagaaucaacuacuauuggacacugcuugagccaggagauacuauuaucuuugaagcaaaugguaaccugauugccccgagguacgcuuucgccuugagccggggcuuugggucgggaaucauaaauucuaacgcgcccauggacaagugugaugcaaaaugccagaccccucaaggcgccauuaauuccucacucccauuccagaacgugcaucccguaacaaucggugaguguccuaaguaugugcgcagugcuaaacugagaauggucaccggguuaaggaauauuccaagcauccagucccggggacuguuuggcgccaucgcaggcuucauugaagggggauggacggguaugguggacggcugguacggguaucaccaccagaacgagcaaggaucuggcuacgcugccgaucagaaaagcacucagaaugcgauaaacgguaucaccaaaaagguuaauucagugauugaaaagaugaacacacaguuuacugccgucgggaaagaguucaauaagcucgagcgccgaauggaaaaccuuaacaaaaagguggacgauggcuucaucgacauauggacauacaaugcagagcuguugguacuacuggaaaacgagagaacccucgauuuucaugacaguaauguuaaaaaccuguaugaaaaggugaagucccaacuuaaaaauaacgcuaaggagauuggaaauggcugcuucgaguuuuaccacaaauguaacgacgaaugcauggagagcgucaagaaugggacguaugauuaccccaaauauucugaagagucaaagcugaacagggagaagaucgacggagugaaauuggaaaguaugggugucuaccagauccucgccauuuauagcaccguggcuuccucucugguuuuacuggugucgcuaggcgccaucagcuucuggaugugcuccaaugggucacuccagugucggauuugcauauga

SEQ ID NO: 125962 - RNA, 1701 nt, Artificial Sequence
  derived and/or modified sequence opt3 from hemagglutinin__InfluenzaA__ADA71152
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgggaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggcguccaccauccuggcacagauaaugaccagaucuuuuuguaugcccaagcuagcgggcguauuacugugucuaccaagagaucccagcagacaguaaucccaaacauaggaucaaggccccggguucgcaauauuccuagcagaaucaguauuuacuggaccaucgugaaaccaggugauauccugcuaauuaacucuacgggcaaucucauagccccgaggggguacuucaagauccgguccggaaaaagcucgauuaugcgcucugacgcgcccaucggcaaguguaacuccgagugcauaacuccuaaugguucaauuccaaacgacaagcccuuucagaaugucaaccgaaucacauauggggcauguccuagauacgugaaacaaaauacccugaagcuggccacuggaaugaggaacgugccagaaaaacagacacggggcaucuucggcgcuauugccggguuuaucgagaauggaugggaagguauggucgauggcugguauggguuccgucaccagaacagugagggacgcggccaagcagcugaccuuaagagcacccaggccgcgauugaucagauaaaugguaaauugaacagacucaucgggaagacgaacgagaaauuccaccagauugaaaaggaguuuuccgaaguugagggcaggauccaagaccuggaaaaguacguggaggauaccaaaaucgacuuauggucuuauaaugccgagcugcucguagcacuugaaaaccagcauacaauugaucugacugacagcgagaugaauaaguuguucgagaaaaccaagaaacagcuacgggaaaacgcugaagauaugggaaauggcugcuuuaagauauaccacaagugugacaacgccugcaucgggucaauucgaaauggaacauaugaucaugacguguaccgcgacgaggcucugaacaauagauuccagaucaaaggugucgagcucaagaguggcuacaaagauuggauucuguggaucuccuuugccauaagcugcuuccuucuguguguggcauugcucggguuuaucaugugggccugccaaaagggaaacauuagguguaauaucugcauuuga

SEQ ID NO: 125963 - RNA, 1698 nt, Artificial Sequence
  derived and/or modified sequence opt3 from hemagglutinin__InfluenzaA__ADA71154
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauagugagugcgaacuccugauuagcaaagaguccuggucuuacaucguugaaaagccuaacccagagaauggaaccuguuauuuuggccauuucgcugauuacgaggaacugagagagcaauuugguucggugagcucauucgaaagguuugagauuuucccgaaggagaguuccuggcccaaccacacugucacaggggugucugccagcugcucccauaauggagaaucaaguuuuuaucggaaccucuuauggcugaccggcaaaaauggccuuuacccuaacuugagcaagucuuaugcaaauaacaaagagaaggaaguacugguucuauggggagugcaccacccacccuccaucaacgaccagaaaacgcucuaccauacugagaaugccuacgucucaguggugagcagucacuauucucgcaaguucaccccugaaauagcuaagcgaccaaaaguccgugaucaggaggggagaaucaacuacuauuggacacugcuugagcccagggacacuauuaucuuugaagcaaaugguaaccugauugccccucgguacgcuuucgccuugucccgcggcuuugggagcggaaucauaaauucgaacgcgccaauggauaagugugacgcaaaaugccagaccccgcaaggcgccauuaauucuucccuccccuuccagaacguucauccugugacaaucggugaguguccaaaguauguaagaucagcuaaacugaggauggugaccggguuacggaauauucccaguauccagagccgcggacuguuuggcgccaucgcaggcuucauugaagggggauggacggguauggucgauggcugguacggguaucaccaccagaacgagcaaggauccggcuacgcugccgaccagaagucuacucagaaugcgauaaacgguaucacaaauaaagugaacagcguuauugaaaagaugaauacccaguucacugccguggggaaggaguuuaacaaacucgagcgaagaauggaaaaccuuaauaagaaagucgaugacggcuucaucgauauauggacauacaacgcagagcuguuggugcuacuggaaaaugagaggacccucgacuuucaugacucaaacguaaagaaucuguaugaaaaaguuaagagucaacuuaagaacaaugcuaaagagauuggaaacggcugcuucgaguuuuaccacaaguguaaugaugaaugcauggaguccgugaaaaacgggacguaugacuacccuaaguauagcgaagagucuaaacugaaucgggagaagaucgauggagucaaguuggaaucaauggguguguaccagauccucgccauuuauaguaccgucgcuagcucccugguguuacugguuucucuaggcgccaucucguucuggaugugcagcaacgggucccuccagugucguauuugcauauga

SEQ ID NO: 125964 - RNA, 1698 nt, Artificial Sequence
  derived and/or modified sequence opt3 from hemagglutinin__InfluenzaA__ADA71158
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagaccuggagcuacaucguugaaaagccaaacccggagaauggaacuuguuaucccggccauuuugcugauuacgaggaacugagagagcaacucuccucugugucgucauucgaaagguuugagauuuucccuaaggagagcaguuggccaaaccacacagucaccgguguguccgccucuugcagccauaauggggaauccucauuuuaucggaacuuacuguggcuuacgggcaaaaauggauuguaccccaaccugaguaagagcuaugcaaauaacaaagagaaggaaguucuaguacucuggggcgugcaccacccuccaucuaucaacgaccagcgcacucuguaccauaccgagaaugccuacgucuccguggugucaagccacuauagucgaaaauucacacccgaaauagcuaagcguccuaaggucagagaucaggaggggaggaucaacuacuauuggacucuucuggagccacgggacaccauuaucuuugaagcaaauggaaacuugauugccccgcgcuacgcuuucgcccucucuagagguuuuggcuccgggaucauaaauagcaacgcgcccauggauaaaugugacgcaaagugccagacaccucaaggagccauuaauucgucucugccauuccagaacguucaucccgugaccaucggcgaguguccuaaauauguaagguccgcuaaguuacggauggugacgggucugcgcaauacuccaucaauucagagucgagggcucuuuggagccaucgcaggcuucaucgaaggcggguggacaggaauggucgaugguugguacggcuaucaccaccagaacgagcaagggagcggauacgcugccgaccagaaauccacccagaaugcgauuaacggcauaacuaauaaggugaacucuguuaucgaaaagaugaauacacaguuuaccgccguggguaaggaguucaacaaacuugagagccugauggauauuuugaacaaaaaggucgacgauggguucaucgacauauggacguacaaugcagaacuacuggugcuccuggagaacgaaagaacccuugacuuucaugauucaaauguuaaaaaccuguaugagaagguaaaaagucaauugaagaauaacgcuaaggaaauuggcaauggaugcuucgaguuuuaccacaaauguaacgacgagugcauggaauccgugaagaauggcacauaugauuaccccaaauauagcgaggaaucuaagcucaacagggagaaaaucgacggggucaagcuggagucaaugggaguguaccagaucuuagccauuuauaguacugucgcuagcucccuggugcuacucguuucucugggugccaucucguucuggaugugcagcaauggcucccuucagugucggauuugcauauga

SEQ ID NO: 125965 - RNA, 1701 nt, Artificial Sequence; identical to SEQ ID NO: 124450
  derived and/or modified sequence opt3 from hemagglutinin__InfluenzaA__ADA71162

SEQ ID NO: 125966 - RNA, 1698 nt, Artificial Sequence
  derived and/or modified sequence opt3 from hemagglutinin__InfluenzaA__ADA71164
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugguuaguaaagagagcugguccuacauuguggaaaagccaaacccggagaauggaaccuguuaucccggccauuuugcugauuacgaggaacugagagagcaacucucuucggucagcucauucgaaagguuugagaucuucccuaaggagaguuccuggccaaaccacacugugacaggugccucugcaagcugcucccauaauggggaaaacucauuuuaucggaauuuacuguggcuuaccggcaaaaacggauuguaccccaaucugaguaagagcuaugccaacaacaaagagaaggaagugcuaguucucuggggcgugcaccacccuccaucuauugcugaccagaaaacgcuguaccauacugagaaugcauacgucuccguggugucaagccacuauagucgcaaguucacccccgaaaucgccaagcgaccuaaaguccgugaucaggaggggagaauacauuacuauuggacacuucuggagccaggagacacuaucauuuuugaagcuaacgguaauuugaucgccccgagguacgcguucgcacucucucggggcuuuggguccggaauuaucaacagcaaugcccccauggauaagugugacgcuaccugccagacaccucaaggcgccauaaacucgucucugccauuccagaauguucaccccgugaccauuggugaguguccuaaauauguacgcuccgcaaaguuaagaauggugacggggcugaggaacaucccaucaauucagagucggggacucuuuggcgcuaucgccggcuucaucgaagggggauggacugguauggucgauggcugguacggguaucaccaucagaaugagcaaggaagcggcuacgcggccgaccagaaauccacacagaacgcaauuaaugguauaaccaacaagguaaauucuguuaucgaaaagaugaacacucaguuuacagcuguggggaaggaguucaauaaacuugagcgccgaauggaaaaccugaacaaaaaggucgaugacggcuucauugauaucuggaccuacaaugccgaguugcuagugcugcucgaaaacgagagaacgcuggacuuucacgacagcaauguuaaaaaccuuuaugaaaagguaauaucacaacugaaaauuaaugcuaaggauuugggauacggcugcuucgaguuuuaucauaaguguaacgacgagugcauggaaagugugaaaaaugggaccuacgauuaucccaaguacuccgaggaaagcaaacucaacagggagaagaucgacggagucaaacuggagucuauggguguguaucagaucuuagccauuuacucaacagucgcaaguagccuggugcuacucguuucccugggcgccaucucuuucuggaugugcucgaaugggagccuucagugucggauuugcauauga

SEQ ID NO: 125967 - RNA, 1698 nt, Artificial Sequence
  derived and/or modified sequence opt3 from hemagglutinin__InfluenzaA__ADA71168
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaaaagcgccccuucagcuggguaacuguucuguggccggcuggauauuggggaauccugagugcggacuccugaucucaaaggaaaguuggagcuacauuguugagagaccaaacccggaaaauggcaccuguuaucccggucauuuugcugacuacgaggagcugagggaacaacucuccucugugucgucauucgagcgguuugaaaucuucccuaaggagagcaguuggccaaaccacacugucacagggguguccgccucuugcagccauaauggagaguccucauuuuauaaaaacuuacuguggcuuaccggcaagaauggcuuguaccccaaccugaguaaaagcuaugcaaauaacaaggaaaaagagguucuaguacucuggggagugcaccacccuccaaacauugggguccagaugacgcuguaccauaaggaaaaugccuacgugucuguggucuccucacacuauagccgcaaguucacucccgagaucguuaaacgaccuaaggugcgugaucaggaagguagaauaaacuacuauuggacccuucuggagccaggcgacacaaucauuuuugaggcuaaugggaacuugaucgcaccgagguacgccuucgcucucagucggggauuuggcucugguauuaucaauuccaacgcccccauggaugaaugugacgcgaaaugccagacuccucaaggggcaauaaauagcucgcugccauuccagaacguacaucccgugaccauuggagaguguccuaaguauguccgcucugccaaauuaagaauggugacaggccugaggaauaucccauccauucagucacggggccucuuuggggcuaucgccggauucaucgaagguggcuggaccgggaugguugauggaugguacggcuaucaccaccagaacgagcaagguaguggguacgcagcugaccaaaagagcacgcagaaugccauuaacggcauaacuaauaaagugaacuccgucaucgaaaagaugaauacacaguuuaccgcggugggaaaggaguucaacaaacuugagcgccgaauggaaaaccugaauaagaaaguagaugacggcuucauugauaucuggacuuacaacgccgaguugcuaguucugcucgaaaaugagagaacacuggacuuucaugacucuaacgugaagaaucuuuaugaaaaagucaagagccagcugaagaacaaugcaaaagagauagggaacggaugcuucgaguuuuaccacaaguguaaugaugaaugcauggagucagugaaaaacgguaccuaugacuaccccaaguauagugaagaguccaaauugaauagggagaagauugauggcgucaagcucgaaagcauggggguguaccagauccuggcuaucuauucuacgguugccucaaguuuagugcugcuaguaagccucggagcuauuuccuucuggaugugcucuaacggcucgcugcagugucggaucugcauuuga

SEQ ID NO: 125968 - RNA, 1698 nt, Artificial Sequence
  derived and/or modified sequence opt3 from hemagglutinin__InfluenzaA__ADA71170
augaaggugaaacugcucguccuucugugcaccuucacagccacuuacgcugacacgaucuguauuggcuaucacgcaaacaauagcaccgauacaguugacacuguguuggagaagaacgggaccguaacacccuccggaaauuuaguggaaaacucuccuaaugguaaacugugccuacucaagggcauaaccccacugcagcuugggaaauguucagucgccggauggauccugggcaacccgaagugggaguugcucgugaguaaggaaagcugguccuacauugguaaaaagcccaauccugagaacgggacuugcuauccaggacauuuucccuacuaugaggagcugagagagcaacugucuucgguuagcagcuucgaaagguuugagaucuucccuaaagaaaguuccuggccaaaucacacagugaccggcgcgucugcuagcuguucccauaacggcgaaaauucauuuuaccggaaccucuuauggcugacggggaagaauggacuuuaucccaacuugaguaaaagcuacgccaauaacaaggagaaggaaguccuggugcuaugggguguacaccauccuccaaacauugcagaucagaaaacucucuaccacaccgagaaugccuauguuucuguggucuccucacacuacagccgcaaguucacaccggaaaucgcuaaacgacccaaggugcgugaccaggagggcagaauaaacuauuacuggacucugcuugaaccuggggauaccaucauuuuugaggcaaauggaaaccugaucgccccaagguaugcuuucgccuugagucggggcuuugguucugggauuaucaauuccaacgcgcccauggacaaaugcgaugcaaagugucagacaccucaaggagccauaaauagcucgcucccauuccagaacgugcaucccgucaccauuggcgagugcccgaaauacguucgcucugcuaagcugagaauggugacgggcuuaaggaauaucccuuccauucagucacgggggcuguuuggagccaucgcagguuucaucgaaggcggguggacuggaaugguagacggcugguaugguuaccaccaucagaacgagcaagggaguggcuacgcugccgaucagaagucaacacagaaugcgauuaacggaauaaccaauaaagugaacuccgucaucgaaaagaugaauacucaguuuacagccgugggcaaagaguucaacaagcucgaacgccgaauggagaaccuuaauaaaaagguugacgauggguucauugacaucuggaccuauaacgcagagcuguuggugcuacuggaaaaugagagaacgcucgauuuucacgacucuaacgucaagaaucuguacgaaaaaguaaagagccaacuuaaaaacaaugcuaaggagauaggaaacgguuguuucgaauuuuaucacaaaugcaaugacgaguguauggagucagugaagaacggcaccuacgauuaucccaaguacagugaagaguccaaacugaauagggaaaagauugacgggguuaaauuggagagcaugggaguguaucagauccucgccaucuacucuacagucgcuucaagucugguguuacuggucagccuaggcgccauuuccuucuggaugugcucuaacgguucgcuccagugccggaucuguauuuga

SEQ ID NO: 125969 - RNA, 1701 nt, Artificial Sequence
  derived and/or modified sequence opt3 from hemagglutinin__InfluenzaA__ADA71172
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaauuuaaguauccagcucugaaugugacaaugcccaacaacgagcaguucgacaaacuuuacauuuggggaguccaccauccuggcacugauaaugaccagaucuuuuuguaugcacaagccagcggccguauuaccgugucuacaaagagaucccagcagaccguaaucccaaacauagggucaaggccccggguucgcaauauuccuagcagaaucaguauuuacuggacgaucgugaaaccaggagauauccugcuaauuaacucuacugguaaucucauagcuccgaggggcuacuucaagauccgguccgggaaaagcucgauuaugcgcucugacgcccccaucggaaaguguaacuccgaaugcauaacaccuaauggcucaauuccaaacgacaagcccuuucagaaugucaaccgaaucaccuauggugcguguccuagauacgugaaacaaaauacucugaagcuggcaacagggaugaggaacgugccagagaaacagacccggggaaucuucggcgccauugcuggcuuuaucgaaaaugggugggagggaauggucgaugguugguauggcuuccgucaccagaacagugaggggcgcggacaagccgcagaccuuaagagcacgcaggcugccauugaucagauaaauggcaaauugaacagacucaucgguaagaccaacgaaaaauuccaccagauugagaaggaauuuuccgagguugaagggaggauccaagaccuggagaaguacguggaggauacaaaaaucgacuuauggucuuauaaugcggaacugcucguagcccuugagaaccagcauacuauugaucugaccgacagcgaaaugaauaaguuguucgagaaaacaaagaaacagcuacgggaaaacgcagaggauaugggcaauggaugcuuuaagauauaccacaagugugacaacgcuugcaucggcucaauucgaaaugggacuuaugaucaugacguguaccgcgacgaggcccugaacaauagauuccagaucaaaggagucgaacucaagagugguuacaaagauuggauucuguggaucuccuuugcuauaagcugcuuccuucuguguguggccuugcucggcuuuaucaugugggcaugccaaaaggggaacauuagguguaauaucugcauuuga

SEQ ID NO: 125970 - RNA, 1698 nt, Artificial Sequence
  derived and/or modified sequence opt3 from hemagglutinin__InfluenzaA__ADA71176
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugccucugcaagcugcucccauaauggggaaaacucauuuuaucggaauuuacuguggcuuaccggcaaaaacggauuguaccccaaucugaguaagagcuaugccaacaacaaagagaaggaagugcuaguacucuggggcguucaccacccuccaaauaucgcuaaccagaaaacgcuguaccauacugagaaugcauacgugucugucguguccucacacuauagccgcaaguucacccccgaaauagccaagcgaccuaaagugcgugaccaggaggggagaaucaacuacuauuggacacuucuggagccaggagauacuauuaucuuugaagcuaaugguaacuugauugccccgagguacgcguucgcacucagucggggcuuugggucuggaaucauaaauuccaacgcccccauggacaagugugaugcuaccugccagacaccucaaggcgccauuaauagcucgcugccauuccagaacguccaucccguuaccaucggugaguguccuaaauaugugcgcucugcaaaguuaagaaugguaacggggcugaggaauauuccauccauccagucacggggacucuuuggcgcuaucgccggcuucauugaagggggauggacugguaugguggacggcugguacggguaucaccaccagaacgagcaaggaaguggcuacgcggccgaucagaaaagcacacagaaugcaauaaacgguaucaccaauaaggucaacuccgugauugaaaagaugaacacucaguuuacagcuguugggaaggaguucaauaaacuugagcgccgaauggaaaaccugaauaaaaagguggacgauggcuucaucgacauauggaccuacaacgccgaguugcuaguccugcucgaaaaugagagaacgcuggauuuucaugacucuaacgugaaaaaucuuuaugaaaagguaaaaagccaacugaagaacaaugcuaaggagauuggaaacggcugcuucgaguuuuaccacaaauguaaugacgaaugcauggagucaguuaagaacgggaccuaugauuaccccaaauauagugaagaguccaaguugaauagggagaaaaucgacggagugaagcucgaaagcaugggugucuaccagauccuggccauuuauucuacaguggcaucaaguuuaguccugcuagugagccucggcgccaucuccuucuggaugugcucuaacgggucgcugcagugucggauuugcauauga

SEQ ID NO: 125971 - RNA, 1701 nt, Artificial Sequence; identical to SEQ ID NO: 125786
  derived and/or modified sequence opt3 from hemagglutinin__InfluenzaA__ADA71181

SEQ ID NO: 125972 - RNA, 1701 nt, Artificial Sequence; identical to SEQ ID NO: 125786
  derived and/or modified sequence opt3 from hemagglutinin__InfluenzaA__ADA71191

SEQ ID NO: 125973 - RNA, 1701 nt, Artificial Sequence
  derived and/or modified sequence opt3 from hemagglutinin__InfluenzaA__ADA79587
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaauauucccuccauacagucaaggggauuguuuggcgcgaucgccggcuucauugaagggggauggacagguaugguggacggcugguacggguaucaucaccagaacgaacaaggaaguggcuacgcagcugaucucaaaagcacccagaaugccaucgacgagauaacgaacaaggucaauuccgugauugagaaaaugaacacccaguuuacagcuguugguaaggaguucaaucaccuggaaaagcggaucgaaaacuuaaauaaaaagguggaugacggguuccuggauaucuggacuuacaacgccgagcuccuuguccuguuggaaaaugagcgcacccuagacuaucaugauucuaacgugaaaaaccuguacgagaagguacgaagccagcucaaaaauaacgcaaaggaaauuggcaauggauguuuugaguucuaucacaagugcgacaacacauguauggaaucaguuaaaaauggcacuuacgauuauccuaaguacagugaggaagccaaacugaacagagaggagaucgacggggugaaacuugaauccaccaggauuuaucaaauacuggcuaucuacagcacagucgcgucuucauuggugcucgucgugagucugggagcaauuagcuuuuggaugugcuccaaugguucuuuacagugccggaucuguaucuga

SEQ ID NO: 125974 - RNA, 1701 nt, Artificial Sequence
  derived and/or modified sequence opt3 from hemagglutinin__InfluenzaA__ADA79607
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacgcguacguguucgucggaaccagucgcuauucuaagaaauuuaagccugagauugcaauccgaccaaaagugcgugaucaggaggguagaaugaauuacuauuggacucugguggaacccggcgacaagauuacauucgaggccacugggaaccuagucguuccuagguacgcuuuugccauggaacggaacgcaggauccggcaucauaauuagcgauaccccagugcaugacugcaauacaaccugucaaacgccgaaaggugcuaucaacacuucgcuccccuuccagaauauucacccuaucacaaucgggaagugcccaaaguauguaaaaucuaccaagcugcgccuugccacuggacugagaaacgugcccuccauucagucaaggggcuuguuuggcgcgauagccggguucaucgagggagguuggacaggcauggucgacgggugguacggauaucaucaccagaaugaacaaggcagugguuacgcagcugaucucaaaagcacccagaacgccauugacgagaucacgaauaaggugaacuccguuauagagaaaaugaauacccaguuuacagcuguggggaaggaguucaaccaccuggagaagcggauugaaaauuuaaacaaaaaggucgaugacggcuuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggaaacggcuguuuugaguucuaucacaagugcgacaauacauguauggaaucagugaaaaacgggacuuacgauuauccuaaguacagugaggaagccaaacugaauagagaggagauugacggagucaaacuugaauccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 125975 - RNA, 1701 nt, Artificial Sequence
  derived and/or modified sequence opt3 from hemagglutinin__InfluenzaA__ADA83043
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagagagaaggaaggaugaauuacuauuggacccugguggagcccggugauaagauuacauucgaagccacuggcaaccuagucguuccucgguacgcuuuugccauggagcgcaacgcagggagcggaaucauaauuucggacaccccagugcaugauugcaauacaaccugucagacgccgaaaggcgcuaucaacacuucucuccccuuccaaaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugagcagggaagcggcuacgcagcugaccucaaauccacccaaaacgccauugaugagaucacgaauaaggugaacucuguuauagaaaagaugaauacccaguuuacagcuguggguaaggaguucaaccaccuggaaaagcgcauugagaauuuaaacaaaaaggucgacgauggguuccuggacaucuggacuuacaaugccgaacuccuugugcuguuggagaacgagcgaacccuagauuaucaugacagcaauguuaaaaaccuguacgaaaagguaagaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagggaggaaauugauggggucaaacuugagagcacccggaucuaucagauucuggcuauauacucuacaguggcgucaaguuugguccucgugguuagccugggagcaaucuccuuuuggaugugcucuaacgguucguuacaaugccguauuuguaucuga

SEQ ID NO: 125976 - RNA, 1701 nt, Artificial Sequence
  derived and/or modified sequence opt3 from hemagglutinin__InfluenzaA__ADA83044
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaaacaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaaggaaaauagcuacccaaaauuaaacaagucuuauauaaaugauaagggaaaagagguacugguucuuuggggcauccaccaccccuccacgucagcugaccaacagagcuuguaccagaacgccgaugcguacguguucgucggcaccagucgcuauucuaagaaauuuaagccugagauugcaauccgaccaaaagugcgugggcaggaaggaagaaugaacuacuauuggacucugguggagcccggugacaagauuacauucgaagccacuggcaaucuagucguuccuagguacgcuuuugccauggagcggaacgcaggguccggaaucauaauuagcgauaccccagugcaugacugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgauggcugguacggguaucaucaccagaaugagcaaggaaguggcuacgcagcugaccucaaaagcacccagaacgccauugacgagaucacgaauaaggugaacuccguuauagaaaagaugaauacccaguuuacagcuguggguaaggaguucaaccaccuggaaaagcggauugagaauuuaaacaaaaaggucgaugacggguuccuggauaucuggacuuacaaugccgaacuccuugugcuguuggagaacgagcgcacccuagacuaucaugauucugacguuaaaaaccuguacgaaaagguacgaagccagcucaaaaauaacgcaaaggagaucggcaauggauguuuugaguucuaucacaagugcgauaacacauguauggagucagugaaaaauggcacuuacgacuauccuaaguacagugaagaggccaaacugaacagagaggaaauugauggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 125977 - RNA, 1701 nt, Artificial Sequence; identical to SEQ ID NO: 124685
  derived and/or modified sequence opt3 from hemagglutinin__InfluenzaA__ADA83580

SEQ ID NO: 125978 - RNA, 1701 nt, Artificial Sequence; identical to SEQ ID NO: 124685
  derived and/or modified sequence opt3 from hemagglutinin__InfluenzaA__ADA83587

SEQ ID NO: 125979 - RNA, 1701 nt, Artificial Sequence
  derived and/or modified sequence opt3 from hemagglutinin__InfluenzaA__ADA83591
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauuagcauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 125980 - RNA, 1701 nt, Artificial Sequence; identical to SEQ ID NO: 125430
  derived and/or modified sequence opt3 from hemagglutinin__InfluenzaA__ADA83595

SEQ ID NO: 125981 - RNA, 1701 nt, Artificial Sequence; identical to SEQ ID NO: 124685
  derived and/or modified sequence opt3 from hemagglutinin__InfluenzaA__ADA83599

SEQ ID NO: 125982 - RNA, 1701 nt, Artificial Sequence; identical to SEQ ID NO: 124685
  derived and/or modified sequence opt3 from hemagglutinin__InfluenzaA__ADA83603

SEQ ID NO: 125983 - RNA, 1701 nt, Artificial Sequence; identical to SEQ ID NO: 124685
  derived and/or modified sequence opt3 from hemagglutinin__InfluenzaA__ADA83611

SEQ ID NO: 125984 - RNA, 1701 nt, Artificial Sequence
  derived and/or modified sequence opt3 from hemagglutinin__InfluenzaA__ADA83615
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugaucugaauguuaaaaaccucuacgagaagguacgaagccagcugaaaaacaaugcaaaggaaaucggcaacggauguuuugaguucuaucacaagugcgacaauacauguauggaaucagugaaaaacggcacuuacgauuauccuaaguacagugaggaagccaaacuuaauagagaggagauugacggggucaagcuggaauccaccaggaucuaucaaauuuuggcuauauacagcacaguggcgucuucacucguccuggugguuaguuuaggagcaaucagcuuuuggaugugcuccaacgguucucugcagugccggauuuguaucuga

SEQ ID NO: 125985 - RNA, 1701 nt, Artificial Sequence
  derived and/or modified sequence opt3 from hemagglutinin__InfluenzaA__ADA83622
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagcgcuuguaccagaacgccgacgcguacguguucgucgggaccagucgauauucuaagaaacugaagccugagauugcaauccguccaaaagugagagaucaggagggaaggaugaauuacuauuggacucuaguggaacccggugacaagauuacauuugaggccacuggcaaccucgucguuccucgguacgcuuucgccauggaacgcaacgcaggguccggaaucauaauuagcgauaccccagugcaugacugcaauacaaccugucaaacgccgaaaggcgcuaucaacacuucgcugcccuuucagaauauucacccuaucacaaucgguaagugcccaaaguauguaaaaucuaccaaacuuagacuggccacuggguugaggaacgugcccuccauucagucacggggacucuucggcgcgauagccggcuuuaucgaagggggauggacagguauggucgacggcugguacggguaucaucaccagaaugaacaaggaaguggcuacgcagcugaucugaaaagcacccagaacgccauugacgagaucacgaauaaggugaacuccguuauagagaaaaugaauacccaguucacagcuguggguaaggaauuuaaccacuuagagaagcgcauugaaaaucugaacaaaaaggucgaugacggguuccucgauaucuggacuuacaaugccgagcuucugguguugcuagaaaacgagcgaacccuggacuaucaugauucuaauguaaagaaccucuacgagaagguuagaagccagcugaaaaacaaugcaaaggaaaucggcaacggauguuucgaguuuuaucacaagugcgacaauacauguauggaaucagugaaaaacggcacuuacgauuauccuaaguacagugaggaagccaaacuuaauagggaggagauugacggggucaagcuggaauccacccggaucuaucaaauuuuggcuauauacagcacaguggcgucuucacucguccuggugguuaguuuaggagcaaucagcuucuggaugugcuccaacgguucucugcagugccguauuuguaucuga

SEQ ID NO: 125986 - RNA, 1701 nt, Artificial Sequence; identical to SEQ ID NO: 124685
  derived and/or modified sequence opt3 from hemagglutinin__InfluenzaA__ADA83633

SEQ ID NO: 125987 - RNA, 1701 nt, Artificial Sequence; identical to SEQ ID NO: 124685
  derived and/or modified sequence opt3 from hemagglutinin__InfluenzaA__ADA83637

SEQ ID NO: 125988 - RNA, 1701 nt, Artificial Sequence; identical to SEQ ID NO: 124685
  derived and/or modified sequence opt3 from hemagglutinin__InfluenzaA__ADA83641

SEQ ID NO: 125989 - RNA, 1701 nt, Artificial Sequence; identical to SEQ ID NO: 124685
  derived and/or modified sequence opt3 from hemagglutinin__InfluenzaA__ADA83645

SEQ ID NO: 125990 - RNA, 1701 nt, Artificial Sequence; identical to SEQ ID NO: 124685
  derived and/or modified sequence opt3 from hemagglutinin__InfluenzaA__ADA83648

SEQ ID NO: 125991 - RNA, 1701 nt, Artificial Sequence; identical to SEQ ID NO: 124685
  derived and/or modified sequence opt3 from hemagglutinin__InfluenzaA__ADA83656

SEQ ID NO: 125992 - RNA, 1701 nt, Artificial Sequence; identical to SEQ ID NO: 124685
  derived and/or modified sequence opt3 from hemagglutinin__InfluenzaA__ADA83660

SEQ ID NO: 125993 - RNA, 1701 nt, Artificial Sequence
  derived and/or modified sequence opt3 from hemagglutinin__InfluenzaA__ADA83664
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagaccgcaauucgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 125994 - RNA, 1701 nt, Artificial Sequence
  derived and/or modified sequence opt3 from hemagglutinin__InfluenzaA__ADA83668
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugaguguggaucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagaacgccgacgcguacguguucgucggaacuucucgcuauuccaagaaauuuaagccugaaauugcaauccgaccaaaagugcgugaucaggaggguagaaugaauuacuauuggacccugguggagcccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacgaaaucacgaauaaggugaacucuguuauagagaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauagcaauguaaagaaccuguacgagaagguucgaucacagcucaaaaacaaugcaaaggagaucggaaacggcuguuuugaguucuaucacaagugcgacaauacauguauggaaagugugaaaaacgggacuuacgauuauccuaaguacuccgaagaggccaaacugaauagagaagagauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 125995 - RNA, 1701 nt, Artificial Sequence; identical to SEQ ID NO: 124685
  derived and/or modified sequence opt3 from hemagglutinin__InfluenzaA__ADA83672

SEQ ID NO: 125996 - RNA, 1701 nt, Artificial Sequence; identical to SEQ ID NO: 124685
  derived and/or modified sequence opt3 from hemagglutinin__InfluenzaA__ADA83676

SEQ ID NO: 125997 - RNA, 1701 nt, Artificial Sequence; identical to SEQ ID NO: 124685
  derived and/or modified sequence opt3 from hemagglutinin__InfluenzaA__ADA83680

SEQ ID NO: 125998 - RNA, 1701 nt, Artificial Sequence
  derived and/or modified sequence opt3 from hemagglutinin__InfluenzaA__ADA86068
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcguaaccaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccauuaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 125999 - RNA, 1701 nt, Artificial Sequence
  derived and/or modified sequence opt3 from hemagglutinin__InfluenzaA__ADA86086
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgaacgcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126000 - RNA, 1701 nt, Artificial Sequence
  derived and/or modified sequence opt3 from hemagglutinin__InfluenzaA__ADA86087
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccuuuucuucggacaacggaacuugcuauccaggcgauuucaucgacuacgaggagcucagggagcagcugucaagcgugaguuccuuugaacgguucgagauuuuuccgaagacaucuagcuggcccaaucacgauuccaacaagggugucaccgccgcuuguccucaugcaggggccaaaucauucuauaagaaucugaucuggcucgugaaaaagggaaacaguuacccaaaauuaagcaagucuuauauaaaugacaagggcaaagaaguacugguucuuuggggcauccaccaccccuccacgucagcugaucaacagagcuuguaccagaacgccgacgcguacguguuugucgggaccagucgcuauucuaagaaauucaagccugagauugcaauccgaccaaaagugcgugaucaggagggaagaaugaauuacuauuggacucugguggaacccggugacaagauuacauuugaggccacuggcaaccuagucguuccuagguacgcuuucgccauggaacggaacgcaggguccggaaucauaauuagcgauaccccagugcaugacugcaauacaaccugucaaacgccgaaaggcgcucucaacacuucgcugcccuuucagaauauccacccuauuacaaucgguaagugcccaaaguauguaaaaucuaccaaacuucgccuggccacuggguugagaaacgugcccuccauccagucaaggggacucuucggcgcgauugccggcuuuauagaagggggauggacagguauggucgacggcugguacggguaucaucaccagaaugaacaaggaaguggcuacgcagcugaucugaaaagcacccagaacgccaucgacgagauuacgaauaaggugaacuccguuaucgagaaaaugaauacccaguucacagcuguggguaaggaguucaaccacuuagaaaagcggauagaaaaucugaacaaaaaggucgaugacggguuucucgauauuuggacuuacaaugccgagcuucugguguugcuagaaaacgagcgcacccuggacuaucaugauucuaauguaaagaaccucuacgagaagguucgaaaccagcugaaaaauaacgcaaaggaaaucggcaauggauguuucgaguuuuaucacaagugcgacaacacauguauggaaagcgugaaaaauggcacuuacgauuauccuaaguacucagaggaagccaaacuuaacagagaggagaucgacggggucaagcuggaaaguaccaggauuuaucaaaucuuggcuauuuacuccacaguggcgagcucucucguccuggugguuucauuaggagcaauaaguuucuggaugugcagcaaugguucccugcagugccggaucuguauuuga

SEQ ID NO: 126001 - RNA, 1701 nt, Artificial Sequence; identical to SEQ ID NO: 125483
  derived and/or modified sequence opt3 from hemagglutinin__InfluenzaA__ADA86088

SEQ ID NO: 126002 - RNA, 1701 nt, Artificial Sequence
  derived and/or modified sequence opt3 from hemagglutinin__InfluenzaA__ADB03603
augaaggccauccugauugugcuccuuuacaccuucgcuacagcacacgccgacacucugugcauaggcuaucaugcgaacaauagcacggauaccgucgacacaguuuuggagaagaacgugacuguaacccacuccgugaauuuacuggaagauaagcauaacgggaaacuauguaagcucagaggagucgcuccccugcaccuugguaaaugcaauaucgccggcuggauucuggggaacccugagugugaaucuuugucaacagcaaguagcugguccuacaucguggagaccucuucgucagacaauggaacuugcuauccaggcgauuuuauugacuacgaggagcucagggagcagcugagcaguguuuccucuuucgaacgguuugagaucuucccgaagacaagcuccuggcccaaccaugauucaaauaagggugugaccgccgcuuguccucacgcaggggccaaaaguuuuuauaagaaccugauauggcucgucaaaaagggaaauagcuacccaaaauuaucuaaguccuauaucaacgacaagggcaaagaagugcugguacuuuggggcauucaccaucccucaacgagcgcugaucaacagaguuuguaccagaaugccgacgcguacguuuucguggggacuucucgcuauuccaagaaauuuaagccugagaucgcaauucgaccaaaaguccgugaucaggagggaagaauggacuacuauuggacccugguggaacccggugauaagaucacauucgaggccacuggcaaccuaguggucccuagguacgcuuuugccauggaacggaaugcagggagcggaauaauuaucucggacaccccaguucacgacugcaacacaaccugucaaacgccgaaaggcgcuauuaacacuucucuccccuuccagaauauccauccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggauggcugguacggguaucaccaccagaaugaacaaggaagcggcuacgcagcugaccucaaauccacccagaacgccaucgaugagauaacgaauaaggucaacucugugauugagaaaaugaauacccaguuuacagcuguugguaaggaguucaaccaucuggaaaagcggaucgaaaauuuaaacaaaaagguggacgauggguuccuggacaucuggacuuacaaugccgagcuccuuguccuguuggaaaacgagcgcacccuagauuaucacgacagcaaugugaaaaaccuguacgagaagguacgaucacagcucaaaaauaacgcaaaggaaauuggcaacggauguuuugaguucuaucauaagugcgauaauacauguauggaaaguguuaaaaacggcacuuacgacuauccuaaguacuccgaggaagccaaacugaauagagaggagaucgauggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 126003 - RNA, 1701 nt, Artificial Sequence; identical to SEQ ID NO: 124672
  derived and/or modified sequence opt3 from hemagglutinin__InfluenzaA__ADB03604

SEQ ID NO: 126004 - RNA, 1701 nt, Artificial Sequence
  derived and/or modified sequence opt3 from hemagglutinin__InfluenzaA__ADB03605
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaauggauuacuauuggacccugguggagcccggugacaagauuacauucgaagccacuggcaaucuagucguuccuagguacgcuuuugccauggagcggaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaucucaaauccacccagaaugccauugacgagaucacgaacaagguaaauucuguuauagaaaagaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugagcgcacccuagacuaucaugauagcaacgugaaaaaucuguacgaaaagguucgaucacagcucaaaaacaacgcaaaggagaucggcaauggauguuuugaguucuaucacaagugcgacaacacauguauggagagugugaaaaauggcacuuacgauuauccuaaguacuccgaagaggccaaacugaacagagaggaaauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126005 - RNA, 1701 nt, Artificial Sequence; identical to SEQ ID NO: 124685
  derived and/or modified sequence opt3 from hemagglutinin__InfluenzaA__ADB03607

SEQ ID NO: 126006 - RNA, 1701 nt, Artificial Sequence; identical to SEQ ID NO: 125038
  derived and/or modified sequence opt3 from hemagglutinin__InfluenzaA__ADB03609

SEQ ID NO: 126007 - RNA, 1701 nt, Artificial Sequence; identical to SEQ ID NO: 124685
  derived and/or modified sequence opt3 from hemagglutinin__InfluenzaA__ADB03611

SEQ ID NO: 126008 - RNA, 1701 nt, Artificial Sequence
  derived and/or modified sequence opt3 from hemagglutinin__InfluenzaA__ADB03612
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccuuuauucagucaaggggauuguucggcgcgauagccggcuuuaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguucacagcuguggguaaggaguucaaccaccuggaaaagcggauugaaaauuuaaacaaaaaggucgaugacggguuucuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuucgaguuuuaucacaagugcgacaauacauguauggaaucagugaaaaacggcacuuacgauuauccuaaguacagugaggaagccaaacugaauagagaggagauugacggggucaaacuugaauccaccaggaucuaucaaauucuggcuauauacagcacaguggcgucuucauugguccucgugguuagucugggagcaaucagcuucuggaugugcuccaacgguucuuuacagugccggauuuguaucuga

SEQ ID NO: 126009 - RNA, 1701 nt, Artificial Sequence; identical to SEQ ID NO: 124685
  derived and/or modified sequence opt3 from hemagglutinin__InfluenzaA__ADB03614

SEQ ID NO: 126010 - RNA, 1701 nt, Artificial Sequence
  derived and/or modified sequence opt3 from hemagglutinin__InfluenzaA__ADB03617
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggaaagugugaaaaacggcacuuacgacuauccuaaguacuccaaagaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126011 - RNA, 1701 nt, Artificial Sequence; identical to SEQ ID NO: 125038
  derived and/or modified sequence opt3 from hemagglutinin__InfluenzaA__ADB03619

SEQ ID NO: 126012 - RNA, 1701 nt, Artificial Sequence
  derived and/or modified sequence opt3 from hemagglutinin__InfluenzaA__ADB03620
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucgauuacgaggaacucagggagcagcugagcaguguguccucuuucgaacgguuugagauugucccgaagacaagcuccuggcccaaucacgacucaaacaagggggugaccgccgcuuguccucaugcaggagccaaaaguuucuauaagaaucugaucuggcucguaaagaagggcaacagcuacccaaaauuaucuaaguccuauauaaaugauaagggcaaagaaguucuggugcuuugggggauccaccaccccucaacgagcgcugaccaacagaguuuguaccagaacgccgaugcguacgucuuugugggaacuucucgcuauuccaagaaauucaagccugagauugcaauccgaccaaaagugcgugaccaggaggguagaaugaauuacuauuggacccuggucgaacccggcgauaagauuacauuugaggccacugggaaccuaguugugccuagguacgcuuucgccauggaacggaacgcaggaagcggcaucauaauuucggacaccccaguacaugauugcaauacaaccugucaaacgccgaaaggugcuaucaacacuucucuccccuuucagaauauucacccuaucacaaucgggaagugcccaaaguaugugaaauccaccaagcugcgccuugccacuggacugagaaacguccccucaauucagaguaggggcuuguucggcgcgauagccggguuuaucgagggagguuggacaggcaugguggacgggugguacggauaucaucaccagaaugaacaaggcagcgguuacgcagcugaccucaaauccacccagaacgccauugaugagaucacgaauaagguuaacucugugauagagaaaaugaauacccaguucacagcugucgggaaggaauuuaaccaccuggagaagcggauugaaaauuuaaacaaaaagguggacgauggcuuccuggacaucuggacuuacaaugccgagcuccuuguacuguuggaaaacgagcgcacccuagauuaucaugacagcaauguuaaaaaccuguacgagaaggugcgaucacagcucaaaaacaaugcaaaggaaaucggaaacggcuguuucgaguuuuaucacaagugcgauaauacauguauggaaagugucaaaaacgggacuuacgacuauccuaaguacuccgaggaagccaaacugaauagagaggagauugauggagugaaacuugaaagcaccaggaucuaucaaauucuggcuauauacucuacagucgcgucaaguuuggugcucguugugagccugggugcaaucuccuucuggaugugcucuaacggcucguuacagugccggauuuguaucuga

SEQ ID NO: 126013 - RNA, 1701 nt, Artificial Sequence
  derived and/or modified sequence opt3 from hemagglutinin__InfluenzaA__ADB03622
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaauggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaccucaaguccacccagaacgccauugauaaaaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgaacgcacccuagauuaucaugacagcaacguaaagaaucuguacgagaagguucgaucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaauagagaagagauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126014 - RNA, 1701 nt, Artificial Sequence; identical to SEQ ID NO: 126013
  derived and/or modified sequence opt3 from hemagglutinin__InfluenzaA__ADB03623

SEQ ID NO: 126015 - RNA, 1701 nt, Artificial Sequence
  derived and/or modified sequence opt3 from hemagglutinin__InfluenzaA__ADB03628
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccacaauauucauccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaccaccagaaugagcagggaagcggcuacgcagcugaucucaaguccacccaaaacgccauugacgagaucacgaauaaagugaacucuguuauagaaaagaugaauacccaguuuacagcuguggguaaagaguucaaccaucuggaaaagcggauugagaauuuaaacaagaaagucgaugacggguuccuggauaucuggacuuacaaugccgaacuccuugugcuguuggagaacgagcgcacccuagacuaucacgauagcaauguaaagaaccuguacgaaaaaguucgaucacagcucaagaacaaugcaaaagagaucggcaacggauguuuugaguucuaucauaagugcgacaauacauguauggaaagugugaagaacggcacuuacgauuauccuaaauacuccgaagaggccaagcugaauagagaggaaauugacggggucaaacuugagagcaccaggaucuaucagauucuggcuauauacucuacaguggcgucaaguuugguccucgugguuagccugggagcaaucuccuuuuggaugugcucuaacgguucguuacaaugccggauuuguaucuga

SEQ ID NO: 126016 - RNA, 1701 nt, Artificial Sequence
  derived and/or modified sequence opt3 from hemagglutinin__InfluenzaA__ADB03629
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguuucaucaccagaaugagcaaggauccggcuaugccgcagaccucaaaucuacgcagaacgcuauugaugagaucaccaauaaggugaacagcguuauagagaaaaugaauacacaguucacugccguggguaaggaguucaaccaccuggaaaagcggauugagaauuuaaacaaaaaggucgacgauggguuucuggacaucuggaccuacaaugcugaacuccuugugcuguuggagaacgagcgcacacuagauuaccaugacucaaauguaaagaaccuguaugaaaagguucgaagucagcucaaaaacaaugccaaggagaucggcaacggauguuucgaauuuuaccacaagugcgauaauacuuguauggaguccgugaaaaacggcaccuaugacuaccccaaguauagcgaagaggcaaaacugaauagagaggaaauugauggggucaaacuugagucuacaaggaucuaccaaauucuggccauauauucaaccguggcuaguagcuugguccucgugguuucccugggagcgaucucuuucuggaugugcucgaacgguagcuuacagugccggauuuguaucuga

SEQ ID NO: 126017 - RNA, 1701 nt, Artificial Sequence
  derived and/or modified sequence opt3 from hemagglutinin__InfluenzaA__ADB03630
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaccagaaugaacaaggaagcggcuaugcagcugaucucaaauccacccagaacgccauugacgagaucacgaauaaggugaacucuguuauagagaaaaugaauacccaguuuacagcuguggguaaggaguucaaccaucuggaaaagcggauugaaaauuuaaacaaaaaggucgaugacggguuccuggauaucuggacuuacaaugccgagcuccuugugcuguuggaaaacgagcgcacccuagacuaccacgauagcaauguuaaaaaccuguaugagaagguacgaucacagcucaaaaacaaugcaaaggaaaucggcaacggauguuuugaguucuaccauaagugcgacaauacauguauggaaagugugaaaaacggcacuuaugauuacccuaaguauuccaaagaggccaagcugaauagagaagagauugacggggucaaacuugagagcaccaggaucuaccaaauucuggcuauauauucuacaguggcgucaaguuugguccucgugguuagccugggagcaaucuccuuuuggaugugcucuaacgguucguuacagugccggauuuguaucuga

SEQ ID NO: 126018 - RNA, 1701 nt, Artificial Sequence; identical to SEQ ID NO: 125430
  derived and/or modified sequence opt3 from hemagglutinin__InfluenzaA__ADB25319

SEQ ID NO: 126019 - RNA, 1701 nt, Artificial Sequence; identical to SEQ ID NO: 124685
  derived and/or modified sequence opt3 from hemagglutinin__InfluenzaA__ADB25321

SEQ ID NO: 126020 - RNA, 1701 nt, Artificial Sequence
  derived and/or modified sequence opt3 from hemagglutinin__InfluenzaA__ADB27970
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacgggaugcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126021 - RNA, 1701 nt, Artificial Sequence; identical to SEQ ID NO: 124685
  derived and/or modified sequence opt3 from hemagglutinin__InfluenzaA__ADB27980

SEQ ID NO: 126022 - RNA, 1701 nt, Artificial Sequence; identical to SEQ ID NO: 124685
  derived and/or modified sequence opt3 from hemagglutinin__InfluenzaA__ADB54352

SEQ ID NO: 126023 - RNA, 1701 nt, Artificial Sequence; identical to SEQ ID NO: 124685
  derived and/or modified sequence opt3 from hemagglutinin__InfluenzaA__ADB54355

SEQ ID NO: 126024 - RNA, 1698 nt, Artificial Sequence
  derived and/or modified sequence opt3 from hemagglutinin__InfluenzaA__ADB65926
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaacacaacgggaagcuaugccuccugaaaggaaaggcgccccuucagcuggguaauuguucuguggccggcuggauauuggggaacccugagugcggacuccugaucucaaaggaaaguuggagcuacauuguugagagaccaaauccggaaaacggcaccuguuaucccggucauuuugcugacuacgaggagcugagggaacaacucuccucugugucgucauucgagcgguuugaaaucuucccuaaagggagcaguuggccaaaucacacugucacaggaguguccgccucuugcagccauaacggcgaguccucauuuuauaagaauuuacuguggcuuaccggcaaaaacggguuguaccccaaucugaguaagagcuaugcaaacaauaaagagaaggaagugcuaguucucuggggagugcaccacccuccaaacauuggugaucagaugacgcuguaccauaaggagaacgccuacgucucugugguguccucacacuauagccgcaaauucacucccgaaaucgcuaagcgaccuaaaguccgugaccaggagggcagaauaaauuacuauuggacccuucuggaaccaggggauacaaucauuuuugaggcaaacggaaauuugaucgccccgagguacgcuuucgcccucagucggggcuuugguucugggauuaucaacuccaaugcgcccauggacgagugugaugcaaagugccagacuccucaaggagccauaaacagcucgcugccauuccagaauguucaucccgugaccauuggcgaauguccuaaauauguacgcucugcuaaguuaagaauggugacaggccugaggaacaucccauccauucagucacgggggcucuuuggagccaucgcagguuucaucgagggcggguggaccggaauggucgacggcugguacgguuaucaccaccagaaugaacaagggaguggcuacgcugccgaucagaaaagcacgcagaacgcgauuaauggaauaacuaacaagguaaauuccguuaucgagaagaugaacacacaguuuaccgccgugggcaaagaguucaauaaacuugaacgccgaauggagaaccugaacaagaaggucgacgauggguucauugacguguggacuuacaaugcagaauugcuaguacugcucgagaacgaaagaacacuggacuuucaugauucuaauguuaaaaaccuuuaugagaaggugaagaaucaacugaaaaacaaugcuaaggaaaugggaaacgguugcuucgaguuuuaccacaaauguaaugacgagugcauggaaagcgucaagaacggcaccuaugauuaccccaaauauucagaggaaaguaaguuguccagggagaagaucgacggggugaaacucgagagcaugggagucuaccagauacuggccauuuauucuacgguggcuucaaguuuaguucugcuagugagccucggcgccaucgguuucuggaugugcuccaaugggucucugcagugucggaucugcauuuga

SEQ ID NO: 126025 - RNA, 1698 nt, Artificial Sequence
  derived and/or modified sequence opt3 from hemagglutinin__InfluenzaA__ADB80153
augaaggugaaacugcucgcccuucugugcaccuucacagcuacuuacgcagacacgaucuguauuggcuaucacgccaacaauagcaccgauacagucgacacuguuuuggagaagaacgugaccguaacacauuccgugaauuuacuggaagauaaccacaaugggaaacuaugccuccugaagggaauagcgccccuucagcuggguaacuguucugucgcuggcuggaucuuggggaauccugagugcgaacuccugauuucaaaagagaguuggagcuacaucguggaaaagccaaacccggagaauggaaccuguuaucccggccauuuugccgacuacgaggaacugagagagcaacucuccucuguuucgucauucgaaagguuugagauuuucccuaaggagagcaguuggccaaaccacacugugacaggugucuccgcaucuugcagccauaauggggaauccucauuuuauaaaaacuuacuguggcuuaccggaaagaauggcuuguaccccaaccugaguaagagcuucgccaauaacaaggagaaagaagugcuaguacucuggggcguucaccacccuccaaacaucggggaucagaugacgcuguaucauaaggagaaugcuuacgugucugucguguccucacacuacagccggaaguuuacucccgaaauagcaaaacgcccuaaggugcgagaccaggagggacguaucaacuauuacuggacccuucuggagccaggugauacaauuaucuucgaagccaauggcaacuugauugcuccgagauaugccuuugcgcucaguaggggguucggaucuggcaucauaaauuccaacgcacccauggacgagugugaugccaaaugccagacuccucaaggugcuauuaauagcucgcugccauuucagaacguccaucccguuaccaucggggaauguccuaaguacgugcggucuacaaaauuacgcaugguaaccggacugagaaauauuccauccauccagucaaggggccucuucggcgccaucgcaggguuuauugagggagguuggacgggcaugguggacgggugguauggauaccaccaccagaacgaacaaggcagugguuaugcugccgaucagaaaagcacucagaaugcgauaaacgggaucacaaauaaagucaacuccgugauugagaagaugaauacccaguucacugccguuggcaaggaguucaacaaacuugaacggcgcauggagaaccugaauaagaaaguggacgauggauuuaucgacgucuggacauacaacgcagaauugcuagugcugcucgagaaugaacgaacccuggacuuccaugauucuaacguaaagaaucuuuacgagaaaguuaagaaccaacugaagaauaacgcuaaagagauaggcaaugggugcuuugaguucuaucacaaguguaacgacgaaugcauggaaagcgugaaaaauggaacguacgauuaucccaaguacucagaggagaguaaauuguccagagaaaagauugacggugucaagcucgagagcaugggcguguaucagauccuggccaucuacucuaccgucgcuucaaguuuagugcugcuaguuagccucggggccauuuccuuuuggaugugcucuaacggaucgcugcaguguaggaucugcauuuga

SEQ ID NO: 126026 - RNA, 1701 nt, Artificial Sequence; identical to SEQ ID NO: 125786
  derived and/or modified sequence opt3 from hemagglutinin__InfluenzaA__ADB81399

SEQ ID NO: 126027 - RNA, 1701 nt, Artificial Sequence; identical to SEQ ID NO: 125786
  derived and/or modified sequence opt3 from hemagglutinin__InfluenzaA__ADB81409

SEQ ID NO: 126028 - RNA, 1701 nt, Artificial Sequence
  derived and/or modified sequence opt3 from hemagglutinin__InfluenzaA__ADB81419
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccugaguacuccgaagaggccaagcugaauagagaggaaaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 126029 - RNA, 1701 nt, Artificial Sequence; identical to SEQ ID NO: 125845
  derived and/or modified sequence opt3 from hemagglutinin__InfluenzaA__ADB81429

SEQ ID NO: 126030 - RNA, 1701 nt, Artificial Sequence
  derived and/or modified sequence opt3 from hemagglutinin__InfluenzaA__ADB81439
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuucccgcuauucuaagaaauuuaagccagagauugcaauccgacccaaagugcguaaucaggagggaagaaugaacuacuauuggacccugguggaaccuggugauaagauuacauucgaggccacuggcaaccuagucguuccaagguacgcuuuugccauggaacggaaugcaggguccggaaucauaauuagcgacaccccggugcaugauugcaacacaaccugucaaacgcccaaaggcgcuaucaauacuucgcucccuuuccagaacauucacccaaucacaaucgguaagugccccaaguauguaaaaucuaccaagcugcgccuugccacugggcugagaaaugugccuuccauucagucaaggggauuguuuggcgcgauagccggcuucaucgaagggggauggacagguauggucgacggcugguacggguaucaucaccagaacgaacaaggaaguggcuacgcagcugaccucaaaagcacccagaaugccauugaugagaucacgaacaaggugaauaguguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacucuaacguaaagaaccuguacgagaagguucgaagccagcucaaaaauaacgcaaaggaaaucggcaauggauguuuugaguucuaucacaagugcgauaacacauguauggaaucagugaaaaauggcacuuacgacuauccaaaguacagugaggaagccaaacugaacagagaggagauugauggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126031 - RNA, 1701 nt, Artificial Sequence
  derived and/or modified sequence opt3 from hemagglutinin__InfluenzaA__ADB81449
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126032 - RNA, 1701 nt, Artificial Sequence
  derived and/or modified sequence opt3 from hemagglutinin__InfluenzaA__ADB81459
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugggggauccggcaucauaauuagcgauaccccagugcaugacugcaacacaaccugucaaacgccgaaaggugcaaucaauacuucgcuccccuuccagaacauucacccuaucacaaucgggaagugcccaaaguauguaaaaucuaccaagcugcgccuugcuacuggacugagaaaugugcccuccauucagucaaggggcuuguuuggcgccauagcgggguucaucgagggagguuggacaggcauggucgacgggugguacggauaucaucaccagaacgaacaaggcagugguuacgccgcagaucucaaaagcacccagaaugcuauugacgagaucacgaacaaggugaauaguguuauagagaaaaugaacacccaguuuacagccguggggaaggaguucaaucaccuggagaagcggauugaaaacuuaaauaaaaaggucgaugacggcuuccuggauaucuggacuuacaacgcugagcuccuugugcuguuggaaaaugagcgcacccuagacuaucaugauucuaacguaaagaaccuguacgagaagguucgaagccagcucaaaaauaacgccaaggaaaucggaaauggcuguuuugaguucuaucacaagugcgacaacacauguauggaaucagugaaaaaugggacuuacgauuauccuaaguacagugaggaagcaaaacugaacagagaggagauugacggagucaaacuugaauccaccaggaucuaucaaauucuggccauauacagcacaguggcuucuucauugguccucgugguuagucugggugcgaucagcuuuuggaugugcuccaauggcucuuuacagugccggauuuguaucuga

SEQ ID NO: 126033 - RNA, 1701 nt, Artificial Sequence
  derived and/or modified sequence opt3 from hemagglutinin__InfluenzaA__ADB82655
augaaggccauccugcucgugcuucugugcaccuuggcugcagccaacgcggacacauuauguauuggcuaccacgcuaauaacagcacugauacggucgacaccguucuggagaaaaaugugacaguaacucauuccgugaaccuacucgaagauagacacaaugggaagcugugcaaccuuaggggaaaagcaccccugcauuuggguaaguguaauauagccggcuggcuccuggggaacccugagugcgaacuacucuucgccgucaauucuuggucauauaucguggagaccaguaacagcgacaauggaacauguuacccaggcgauuuuaccuccuaugaagaguuacgggagcagcugucuucgguuagcucauucgaacgcuuugagauuuucccgaaagcuaguuccuggcccaaccacgaaacuaaucgaggugugacagcagccugcccuuacgcugggaccaacggauuuuaucguaaucuuaucugguuggucaagaaggagaacucuuacccaaaacugagaaagagcuaugugaacaauaaaaagaaagagguacugguucucuggggcauucaucaucccccuacgaacacugaccaacagucccuguaccagaaugccgaugcguacguguucgucggcucaaguaaguauagcaggaaguuuaaaccagaaaucgcagagcggcccaaggugcgcgggcaggccggaagaaugaacuacuauuggacccuuauagaaccuggugacacaaucacuuucgaggcuaccggcaaucugguggccccaagguacgcauuugcuaugaaccgggggccggucucuggaauuaucacauccgaugcccccguucacgacuguaaugcgaccugccaaacgccuaaaggcgccauuaacacuucauugccauuccagaauauccaccccauaacaauuggugaauguccuaaguaugugaaaagcacccgccuccgaauggcaacugggcugagaaacaucccaaguauucagucuaggggauuauuuggcgcuaucgccggcuucaucgaagggggauggacagguaugauugauggcugguacggguaucaccaucagaauggacaaggcuccgguuacgcugccgaccaaaagagcacccagaacgcaauagaucggaucacgaauaaaguaaacucggugauugagaagaugaauauccaguuuaccgccgucgggaaggaguucaaccaccuggagcgucgcauagaaaaccucaauaaaaagguggacgacggcuuccuugauguuuggacauacaacgcugagcuguuggugcuacuggaaaaugagagaacucucgacuuucacgauucuaacgucaaaacccuguaugagaaggugaaaacacagcuuaggaauaacgcgaaggaaauuggaaauggcugcuucgaguuuuaccauaagugugacgauacuugcauggaauccaucaaaaacgggaccuauaauuaccccaaguauucagaggaaaguaaacugaaccgggaggagaucgacggaguaaaguuggaaagcacacgaauuuaccagauccucgcaauuuauuccaccgccgcuucuagccugguuuuacuggugucacuaggugccauaggcuucuggaugugcaguaaugggucccuccagugucgcaucugcauuuga

SEQ ID NO: 126034 - RNA, 1701 nt, Artificial Sequence
  derived and/or modified sequence opt3 from hemagglutinin__InfluenzaA__ADB82656
augaaggccauccugcucgugcuucagugcauucugaccgcugcaaacgccgacacauuguguauaggcuaccacgcgaauaacagcacugauacggucgacaccguuuuagagaaaaaugugacaguaacucauuccgugaaccugcuagaagauagacacaaugggaagcucugcaaacugaagggaaucgcuccccuucaucuggguaaauguaacauugccggcugguugcucgggaauccugagugcgaacugcuguucaaggcaaacucuuggucauauaucgucgagaccaguuacagcgacaauggaacauguuauccaggcgauuuuaccaacuacgaagaacucagggagcaauuauccucugugucgucauucgaacgguuugagauguucccgaaggccaauagcuggcccaaccacgaaacuaauaaagguguuacagcugcaugcccuuaugccggggcuaacaguuuuuaccgcaaucugauuuggcuugugaagaaaggaaacuccuauccacgauugucuaagagcuacgucaacaauaaaaagaaggaggugcugguacuauggggcauccaucaccccuccaccucaacggaccagcagagucucuaccagaacgccgaugcguauguuuucgugucuagcuccacuuacaauaaacguuuuaagccugagauaggcaccagaccaaaagucagggaccaaucagggcggaugaacuauuacuggacaaucguggaacccggagauacuauuaccuucgaggcaacagguaaucugguggccccucgcuaugcuuuugccaugaagagagacagcggcagugggaucauuaugucugauaccccaguccacgacuguaacacgacuugccagacaccgaaaggagcaaucaauaccucccuucccuuccagaacguucauccugugacuauaggcgaauguccaaaguacguaaaaagcacaaagcugaggauggcuaccgguuugcggaauauucccucgauccagucucgcgggcucuuuggagccauugcgggcuucaucgagggcggguggacgggaaugaucgaugguugguauggcuaccaccaucaaaacgaacagggguccggauacgccgcagaccgaaagucaacccagaaugcuauugacggcauaacaaacaaagugaauaguaucauugagaagaugaacauccaguuuacugccgucgguaaagaguucagccaccuggaaaagagaguggagaauuuaaacaaaaagguugaugacggguuccuggauguguggaccuauaacgcugaacuccuuguccuguuggagaaugaaaggacacuagacuaccacgauuccaacgugaagaaucuguaugagaaaguacggucucaacucaagaacaaugccaaagagauaggcaacggaugcuuugaguucuaccauaagugugacgauagcugcauggagucaauuaaaaaugaaacuuaugacuacaguaaguauuccgaggaaagccgucugaaccgcgagaagaucgauggcguuaaacuugagucuacccagaucuaccagauucuggcaaucuacucaacaguggccaguagcuugguccuccugguguccuuaggggcuauuucuuuuuggaugugcucgaauggaagccugcaauguagaauaugcaucuga

SEQ ID NO: 126035 - RNA, 1701 nt, Artificial Sequence
  derived and/or modified sequence opt3 from hemagglutinin__InfluenzaA__ADB82944
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacauuccuuccauacagucaaggggauuguuuggcgcgaucgccggcuucauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggcaacggauguuuugaguucuaucacaagugcgacaauacauguauggaaucaguuaaaaacggcacuuacgauuauccaaaguacagugaggaagccaaacugaauagagaggagaucgacggggugaaacuugaauccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 126036 - RNA, 1701 nt, Artificial Sequence
  derived and/or modified sequence opt3 from hemagglutinin__InfluenzaA__ADB82950
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuugagccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126037 - RNA, 1701 nt, Artificial Sequence; identical to SEQ ID NO: 125483
  derived and/or modified sequence opt3 from hemagglutinin__InfluenzaA__ADB89129

SEQ ID NO: 126038 - RNA, 1701 nt, Artificial Sequence; identical to SEQ ID NO: 124685
  derived and/or modified sequence opt3 from hemagglutinin__InfluenzaA__ADB89139

SEQ ID NO: 126039 - RNA, 1701 nt, Artificial Sequence
  derived and/or modified sequence opt3 from hemagglutinin__InfluenzaA__ADB89149
augaaggccauccuggugguccuccuuuacaccuucgcuacagcaaacgccuauacucugugcauuggcuaccacgcgaauaacagcacggacaccguugauacaguguuggagaaaaauguaacugugacccauuccgucaacuuacuggaagacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuucgucagauaacggaacuugcuacccaggcgacuuuaucgauuaugaagaacucagggagcagcugagcaguguguccucuuucgaacgguuugagauuuucccgaagacaagcuccuggcccaaucacgacucaaacaagggugucaccgccgcuuguccucaugugggggcaaaaaguuuuuacaagaaucugaucuggcucguaaagaagggaaacagcuauccaaaauuaucuaaguccuacauaaaugauaagggcaaagaaguucuggugcuuuggggcauccaccaccccucaacgagcgccgaccaacagaguuuguaccagaacgcugaugccuaugucuucguggggacuucucgcuacuccaagaaauuuaagccugagauugcgauccgaccaaaagugcguggacaggaggguagaaugaauuauuacuggacccuggucgaacccggcgacaagauuacauucgaggcaacugggaaccuaguugugccuagguaugccuuugcuauggaacggaacgccggaagcggcaucauaauuucggauaccccaguacaugacugcaauacaaccugucaaacgccgaaaggugcaaucaacacuucucuccccuuccagaauauucacccuaucacaaucgggaagugcccaaaguacgugaaauccaccaagcugcgccuugcuacuggacugagaaacauucccucaauacagaguaggggcuuguuuggcgccaucgcgggguucauugagggagguuggacaggcauggucgaugggugguauggauaccaucaccagaaugaacaaggcagcgguuacgccgcagaccucaaauccacccagaacgcuaucgacgagauaacgaauaaggugaacucuguuauugagaaaaugaauacccaguuuacagccguggggaaggaguucaaccaccuggagaagcggaucgaaaauuuaaacaaaaaggucgaugacggcuuccuggauaucuggacuuauaaugcugagcuccuugugcuguuggaaaacgagcgcacccuagacuaccaugauagcaauguuaaaaaccuguaugagaagguacgaucacagcucaaaaacaaugccaaggaaauuggaaacggcuguuuugaguucuaccacaagugcgacaauacauguauggaaagugugaaaaacgggacuuaugauuacccuaaguauuccgaggaagcaaaacugaauagagaggagaucgacggagucaaacuugaaagcaccaggauuuaccaaauacuggccaucuacucuacaguggcuucaaguuugguccucgugguuagccugggugcgauuuccuuuuggaugugcucuaacggcucguuacagugccggaucuguaucuga

SEQ ID NO: 126040 - RNA, 1701 nt, Artificial Sequence; identical to SEQ ID NO: 125038
  derived and/or modified sequence opt3 from hemagglutinin__InfluenzaA__ADB89150

SEQ ID NO: 126041 - RNA, 1701 nt, Artificial Sequence
  derived and/or modified sequence opt3 from hemagglutinin__InfluenzaA__ADB89221
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaacuuguaccagaaugccgacgcguacguguucgucgggaguucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 126042 - RNA, 1701 nt, Artificial Sequence; identical to SEQ ID NO: 124738
  derived and/or modified sequence opt3 from hemagglutinin__InfluenzaA__ADB89241

SEQ ID NO: 126043 - RNA, 1701 nt, Artificial Sequence; identical to SEQ ID NO: 124685
  derived and/or modified sequence opt3 from hemagglutinin__InfluenzaA__ADB89251

SEQ ID NO: 126044 - RNA, 1701 nt, Artificial Sequence; identical to SEQ ID NO: 125132
  derived and/or modified sequence opt3 from hemagglutinin__InfluenzaA__ADB89261

SEQ ID NO: 126045 - RNA, 1701 nt, Artificial Sequence
  derived and/or modified sequence opt3 from hemagglutinin__InfluenzaA__ADB89271
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguaugggcuccgugaaaaacgggacauacgauuauccuaaguacagcgaagaggccaaacugaauagagaagagauugacggagucaaacuugagucuacuaggaucuaucaaauucuggcuauauacucaaccguggcgaguagcuugguccucgugguuucccugggugcaaucucuuuuuggaugugcucgaacggcagcuuacagugccggauuuguaucuga

SEQ ID NO: 126046 - RNA, 1701 nt, Artificial Sequence
  derived and/or modified sequence opt3 from hemagglutinin__InfluenzaA__ADB89281
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaucccccuacgucagcugaucaacagagcuuguaccagaacgccgacgcguacguguucgucgggaccagucgcuauucuaagaaauuuaagccagagauugcaauccgacccaaagugcguggacaggaggguagaaugaauuacuauuggacucugguggaaccuggcgauaagauuacauucgaggccacugggaaccuagucguuccaagguacgcuuuugccauggaacggaacgcaggauccggcaucauaauuagcgacaccccggugcacgauugcaauacaaccugucaaacgcccaaaggugcuaucaacacuucgcucccuuuccagaauauucacccaaucacaaucgggaagugccccaaguauguaaaaucuaccaagcugcgccuugccacuggacugagaaacgugccuuccauucagucaaggggcuuguuuggcgcgauagccggguucaucgagggagguuggacaggcauggucgacgggugguacggauaucaucaccagaaugaacaaggcagugguuacgcagcugaccucaaaagcacccagaacgccauugaugagaucacgaauaaggugaacuccguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacucuaauguaaagaaccuguacgagaagguucgaagccagcucaaaaacaaugcaaaggaaaucggaaacggcuguuuugaguucuaucacaagugcgauaauacauguauggaaucagugaaaaacgggacuuacgacuauccaaaguacagugaggaagccaaacugaauagagaggagauugauggagucaaacuugaauccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 126047 - RNA, 1701 nt, Artificial Sequence; identical to SEQ ID NO: 124685
  derived and/or modified sequence opt3 from hemagglutinin__InfluenzaA__ADB89291

SEQ ID NO: 126048 - RNA, 1701 nt, Artificial Sequence; identical to SEQ ID NO: 124685
  derived and/or modified sequence opt3 from hemagglutinin__InfluenzaA__ADB89301

SEQ ID NO: 126049 - RNA, 1701 nt, Artificial Sequence; identical to SEQ ID NO: 124685
  derived and/or modified sequence opt3 from hemagglutinin__InfluenzaA__ADB89311

SEQ ID NO: 126050 - RNA, 1701 nt, Artificial Sequence
  derived and/or modified sequence opt3 from hemagglutinin__InfluenzaA__ADB89321
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucugaauccuauauaaaugacaagggcaaggagguacugguucuuuggggcauccaccaccccucaacgagcgcugaucaacagaguuuguaccagaacgccgacgcguacguguucgucgggacuucuaaauauuccaagaaauuuaagccugagauugcaauccgcccaaaagugcgagaucaggaaggacguaugaauuacuauuggacccugguggagcccggugacaagauuacauucgaagccacuggcaaccuagucguuccuagauacgcuuuugccauggagaggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcggcuugccacugggcugcgcaacgugcccucaauucagaguagaggauuguuuggcgcgauagccggcuucaucgaagggggauggacagguauggucgacggcugguacggguaucaucaccagaaugagcaaggaagcggcuacgcagcugaucucaaauccacccagaacgccauugacgagaucacgaauaaggugaacucuguuauagaaaagaugaauacccaguuuacagcuguggguaaggaguucaaccaccuggaaaagaggauugagaauuuaaacaaaaaggucgaugacggguuccuggauaucuggacuuacaaugccgaacuccuugugcuguuggagaacgagcggacccuagacuaucaugauagcaauguuaaaaaccuguacgaaaagguacgcucacagcucaaaaacaaugcaaaggagaucggcaacggauguuuugaguucuaucacaagugcgacaauacauguauggagagugugaaaaacggcacuuacgauuauccuaaguacuccgaagaggccaaacugaaucgagaggaaauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 126051 - RNA, 1701 nt, Artificial Sequence
  derived and/or modified sequence opt3 from hemagglutinin__InfluenzaA__ADB89331
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaauuuaaccaccuggagaaaaggauugaaaauuuaaacaagaaagucgaugacggguuccuggauaucuggacauacaaugccgagcuccuugugcuguuggaaaacgagcggacucuagacuaucaugauucaaauguaaagaaccuguacgagaaaguucgcagucagcucaagaacaaugcaaaggaaaucggcaacggauguuucgaguucuaucacaaaugcgacaauaccuguauggaauccgugaagaacggcacauacgauuauccuaaauacagcgaggaagccaagcugaaucgagaggagauugacggggucaaacuugaaucuacuagaguguaucaaauccuggcuauuuacucaaccgucgcgaguagcuuggugcucguugugucccugggagcaauaucuuuuuggaugugcucgaacgguagcuuacagugcaggaucuguauuuga

SEQ ID NO: 126052 - RNA, 1701 nt, Artificial Sequence; identical to SEQ ID NO: 124685
  derived and/or modified sequence opt3 from hemagglutinin__InfluenzaA__ADB89341

SEQ ID NO: 126053 - RNA, 1701 nt, Artificial Sequence; identical to SEQ ID NO: 124685
  derived and/or modified sequence opt3 from hemagglutinin__InfluenzaA__ADB89351

SEQ ID NO: 126054 - RNA, 1701 nt, Artificial Sequence; identical to SEQ ID NO: 124685
  derived and/or modified sequence opt3 from hemagglutinin__InfluenzaA__ADB89361

SEQ ID NO: 126055 - RNA, 1701 nt, Artificial Sequence; identical to SEQ ID NO: 124685
  derived and/or modified sequence opt3 from hemagglutinin__InfluenzaA__ADB89371

SEQ ID NO: 126056 - RNA, 1701 nt, Artificial Sequence; identical to SEQ ID NO: 125430
  derived and/or modified sequence opt3 from hemagglutinin__InfluenzaA__ADB89381

SEQ ID NO: 126057 - RNA, 1701 nt, Artificial Sequence
  derived and/or modified sequence opt3 from hemagglutinin__InfluenzaA__ADB89391
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggacuucucgcuauuccaagaaauuuaagcccgagauugcaauccgaccuaaagugcgugaucaggagggaagaaugaauuacuauuggacccuaguggaaccaggugacaagauuacauucgaggccacuggcaaccucgucguucccagguacgcuuuugccauggaacggaacgcagggagcggaaucauaauuucggauaccccugugcaugacugcaauacaaccugucaaacgccaaaaggcgcuaucaacacuucucugccguuccagaauauucaccccaucacaaucgguaagugcccuaaguauguaaaauccaccaaacuucgccuggccacuggguugagaaacgugccaucaauucagaguaggggacucuuuggcgcgauagccggcuucaucgaagggggauggacagguaugauugacggcugguacggguaucaucaccagaaugaacaaggaagcggcuacgcagcugaucugaaguccacccagaacgccaucgacgagauaacgaauaaggucaacucugugauugagaaaaugaauacccaguuuacagcuguugguaaggaguucaaccacuuagaaaagcggaucgaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaauuggcaacggauguuuugaguucuaucacaagugcgacaauacauguauggaaaguguuaaaaacggcacuuacgauuaucccaaguacuccgaggaagccaaacuuaauagagaggagaucgacggggugaagcuggaaagcaccaggauuuaucaaauauuggcuaucuacucuacagucgcgucaagucucgugcuggucgugagcuuaggagcaauuuccuuuuggaugugcucuaacgguucgcugcagugccggaucuguaucuga

SEQ ID NO: 126058 - RNA, 1701 nt, Artificial Sequence; identical to SEQ ID NO: 124672
  derived and/or modified sequence opt3 from hemagglutinin__InfluenzaA__ADB89401

SEQ ID NO: 126059 - RNA, 1701 nt, Artificial Sequence; identical to SEQ ID NO: 124685
  derived and/or modified sequence opt3 from hemagglutinin__InfluenzaA__ADB89411

SEQ ID NO: 126060 - RNA, 1701 nt, Artificial Sequence; identical to SEQ ID NO: 125132
  derived and/or modified sequence opt3 from hemagglutinin__InfluenzaA__ADB89431

SEQ ID NO: 126061 - RNA, 1701 nt, Artificial Sequence; identical to SEQ ID NO: 125038
  derived and/or modified sequence opt3 from hemagglutinin__InfluenzaA__ADB89441

SEQ ID NO: 126062 - RNA, 1701 nt, Artificial Sequence; identical to SEQ ID NO: 124685
  derived and/or modified sequence opt3 from hemagglutinin__InfluenzaA__ADB89461

SEQ ID NO: 126063 - RNA, 1701 nt, Artificial Sequence; identical to SEQ ID NO: 125132
  derived and/or modified sequence opt3 from hemagglutinin__InfluenzaA__ADB89481

SEQ ID NO: 126064 - RNA, 1701 nt, Artificial Sequence; identical to SEQ ID NO: 125132
  derived and/or modified sequence opt3 from hemagglutinin__InfluenzaA__ADB89491

SEQ ID NO: 126065 - RNA, 1701 nt, Artificial Sequence
  derived and/or modified sequence opt3 from hemagglutinin__InfluenzaA__ADB89501
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacuggucucgucgacggcugguacggguaucaucaccagaaugaacaaggauccggcuacgcagcugaucugaaaucuacacagaacgccauugacgagaucaccaauaaggugaacagcguuauagagaaaaugaauacgcaguuuaccgcuguggguaaggaguucaaccacuuagaaaagcggauugaaaaucugaacaaaaaggucgaugacggguuccucgauaucuggacauacaaugccgagcuucugguguugcuagaaaacgagcgcacucuggacuaucaugauucaaauguuaaaaaccucuacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacuuaauagagaggagauugacggggucaagcuggaaucuacuaggaucuaucaaauuuuggcuauauacucaaccguggcgaguagccucguccuggugguuuccuuaggagcaaucucuuuuuggaugugcucgaacgguagccugcagugccggauuuguaucuga

SEQ ID NO: 126066 - RNA, 1701 nt, Artificial Sequence; identical to SEQ ID NO: 124685
  derived and/or modified sequence opt3 from hemagglutinin__InfluenzaA__ADB89511

SEQ ID NO: 126067 - RNA, 1701 nt, Artificial Sequence; identical to SEQ ID NO: 125132
  derived and/or modified sequence opt3 from hemagglutinin__InfluenzaA__ADB89531

SEQ ID NO: 126068 - RNA, 1701 nt, Artificial Sequence; identical to SEQ ID NO: 125132
  derived and/or modified sequence opt3 from hemagglutinin__InfluenzaA__ADB89541

SEQ ID NO: 126069 - RNA, 1701 nt, Artificial Sequence; identical to SEQ ID NO: 125845
  derived and/or modified sequence opt3 from hemagglutinin__InfluenzaA__ADB89551

SEQ ID NO: 126070 - RNA, 1701 nt, Artificial Sequence; identical to SEQ ID NO: 124685
  derived and/or modified sequence opt3 from hemagglutinin__InfluenzaA__ADB89561

SEQ ID NO: 126071 - RNA, 1701 nt, Artificial Sequence; identical to SEQ ID NO: 124685
  derived and/or modified sequence opt3 from hemagglutinin__InfluenzaA__ADB89571

SEQ ID NO: 126072 - RNA, 1701 nt, Artificial Sequence; identical to SEQ ID NO: 124685
  derived and/or modified sequence opt3 from hemagglutinin__InfluenzaA__ADB89581

SEQ ID NO: 126073 - RNA, 1701 nt, Artificial Sequence
  derived and/or modified sequence opt3 from hemagglutinin__InfluenzaA__ADB89591
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauugggcccugguggagcccggugauaagauuaccuucgaagcuacaggcaaccuagucguuccuagguacgccuuugcaauggagcggaacgcugggagcggaaucauaauuucggacacuccagugcaugauugcaauaccacaugucaaaccccgaaaggcgccaucaacacgucucuccccuuccagaauauucacuccaucacuaucgguaagugcccuaaguauguaaaaucaacaaagcugcgccuugcgaccgggcugagaaacgugccaaguauucagagcaggggauuguuuggcgccauagcaggcuucaucgaagggggauggacugguauggucgacggcugguacggguaucaucaccagaaugagcaaggauccggcuacgcugccgaccucaaaucuacacagaacgcuauugaugagaucaccaauaaggugaacagcguuauagaaaagaugaauacgcaguuuaccgccguggguaaggaguucaaccaccuggaaaagcggauugagaauuuaaacaaaaaggucgacgauggguuccuggacaucuggacauacaaugcagaacuccuugugcuguuggagaacgagcgcacucuagauuaucaugacucaaauguuaaaaaccuguacgaaaagguacgaagucagcucaaaaacaaugccaaggagaucggcaacggauguuuugaguucuaucacaagugcgauaauaccuguauggaguccgugaaaaacggcacauacgacuaucccaaguacagcgaagaggcuaaacugaauagagaggaaauugauggggucaaacuugagucuacuaggaucuaucaaauucuggcgauauacucaaccguggcaaguagcuugguccucgugguuucccugggagccaucucuuuuuggaugugcucgaacgguagcuuacagugccggauuuguaucuga

SEQ ID NO: 126074 - RNA, 1701 nt, Artificial Sequence
  derived and/or modified sequence opt3 from hemagglutinin__InfluenzaA__ADB89601
augaaggccaucauugugguccugcucuacaccuucgcuacagcaaacgccgacacucuuugcauaggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacaagauaacgaauaaagugaacucuguuauugagaagaugaauacccaguuuacagcuguggguaaggaguucaaccaccucgaaaaacggaucgagaaucugaacaagaaagucgaugacggguucuuagauaucuggacuuacaaugccgaacugcucgugcuucuggagaacgaacgcaccuuggacuaucaugauagcaauguaaagaaccuauacgagaaaguucgaucacagcugaagaacaaugcaaaggagauuggcaacggauguuuugaguucuaucacaaaugcgacaauacauguauggagagugugaagaacggcacuuacgauuauccuaaauacuccgaagaggccaagcucaauagagaagagaucgacggggucaaacuggagagcaccaggauuuaucaaauacuuacaaucuacucuaccguggcuucaagucuggucuuggugguuagccucggagcgauuuccuuuuggaugugcucuaacgguucgcugcagugccggaucuguaucuga

SEQ ID NO: 126075 - RNA, 1701 nt, Artificial Sequence; identical to SEQ ID NO: 125849
  derived and/or modified sequence opt3 from hemagglutinin__InfluenzaA__ADB89611

SEQ ID NO: 126076 - RNA, 1701 nt, Artificial Sequence; identical to SEQ ID NO: 125849
  derived and/or modified sequence opt3 from hemagglutinin__InfluenzaA__ADB89621

SEQ ID NO: 126077 - RNA, 1701 nt, Artificial Sequence
  derived and/or modified sequence opt3 from hemagglutinin__InfluenzaA__ADB89631
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacauacccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 126078 - RNA, 1701 nt, Artificial Sequence; identical to SEQ ID NO: 125849
  derived and/or modified sequence opt3 from hemagglutinin__InfluenzaA__ADB89641

SEQ ID NO: 126079 - RNA, 1701 nt, Artificial Sequence; identical to SEQ ID NO: 124685
  derived and/or modified sequence opt3 from hemagglutinin__InfluenzaA__ADB89651

SEQ ID NO: 126080 - RNA, 1701 nt, Artificial Sequence; identical to SEQ ID NO: 124685
  derived and/or modified sequence opt3 from hemagglutinin__InfluenzaA__ADB89661

SEQ ID NO: 126081 - RNA, 1701 nt, Artificial Sequence; identical to SEQ ID NO: 125849
  derived and/or modified sequence opt3 from hemagglutinin__InfluenzaA__ADB89671

SEQ ID NO: 126082 - RNA, 1701 nt, Artificial Sequence; identical to SEQ ID NO: 124685
  derived and/or modified sequence opt3 from hemagglutinin__InfluenzaA__ADB89681

SEQ ID NO: 126083 - RNA, 1701 nt, Artificial Sequence; identical to SEQ ID NO: 124685
  derived and/or modified sequence opt3 from hemagglutinin__InfluenzaA__ADB89691

SEQ ID NO: 126084 - RNA, 1701 nt, Artificial Sequence; identical to SEQ ID NO: 125787
  derived and/or modified sequence opt3 from hemagglutinin__InfluenzaA__ADB89701

SEQ ID NO: 126085 - RNA, 1701 nt, Artificial Sequence
  derived and/or modified sequence opt3 from hemagglutinin__InfluenzaA__ADB89711
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuaccauuggacccugguggaacccggcgauaagauuacauucgaggccacugggaaccuagucguuccuagguaugcuuuugccauggaacggaacgcaggaagcggcaucauaauuucggacaccccagugcacgauugcaauacaaccugucaaacgccgaaaggugcuaucaacacuucucuccccuuccagaauauucauccuaucacaaucgggaagugcccaaaguacguaaaauccaccaagcugcgccuugccacuggacugagaaacgugcccucaauucagaguaggggcuuguuuggcgcgauagccggguucaucgagggagguuggacaggcauggucgacgggugguauggauaccaccaccagaaugaacaaggcagcgguuaugcagcugaccucaaauccacccagaacgccauugaugagaucacgaauaaggugaacucuguuauagagaaaaugaauacccaguuuacagcuguggggaaggaguucaaccaucuggagaagcggauugaaaauuuaaacaaaaaggucgacgauggcuuccuggacaucuggacuuacaaugccgagcuccuugugcuguuggaaaacgagcgcacccuagauuaccacgacagcaauguaaagaaccuguaugagaagguucgaucacagcucaaaaacaaugcaaaggaaaucggaaacggcuguuuugaguucuaccauaagugcgauaauacauguauggaaagugugaaaaacgggacuuaugacuacccuaaguauuccgaggaagccaaacugaauagagaggagauugauggagucaaacuugaaagcaccaggaucuaccaaauucuggcuauauauucuacaguggcgucaaguuugguccucgugguuagccugggugcaaucuccuuuuggaugugcucuaacggcucguuacagugccggauuuguaucuga

SEQ ID NO: 126086 - RNA, 1701 nt, Artificial Sequence
  derived and/or modified sequence opt3 from hemagglutinin__InfluenzaA__ADB89721
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuugacaacgaauccuucaauuggacagguguuacccagaacgggacgucuagcgcuugcauccggcgcuccaaaaauucauuuuucagucgacugaacuggcucacucauuuaaauuuuaaauauccagcacugaacgugaccaugcccaauaacgagcaguucgauaaguuguacuuguggggaguccaccauccuggcacagacaaagaucagauuuuucuguaugcccaagcuagcggccguaucacugugucuaccaagagaucccagcagacaguaauuccaaacaucgggucaaggccccggguucgcaauauaccuagcagaauuaguaucuacuggaccauugugaaaccaggagacauccuacucaucaacucuacggguaaucugauugccccgaggggcuacuucaagauacaguccggaaagagcucgaucaugcggucugacgcgcccauugggaaauguaacuccgagugcaucacuccuaauggcucaauaccaaacgauaagcccuuucaaaaugucaaccgcauuacauauggugcauguccucgauacgugaaacagaauacccuuaagcuggccacugggaugagaaacgugccagaaaaacagacaaggggaaucuucggcgcuaucgccggcuuuauugagaaugggugggaaggaauggucgacgguugguauggcuuccggcaccaaaacagugaggggcguggacaggcagcugaucuuaagagcacccaggccgcgaucgaccagauuaauggcaaacucaaccgccugauagguaagacgaaugagaaguuccaccaaaucgaaaaagaguuuuccgaaguugaggggaggauucaggauuuagaaaaguacguggaggacaccaaaaucgaucuguggucuuauaacgccgagcuccuuguagcacuggaaaaccagcauacaaucgacuugacugauagcgagaugaauaagcuauucgaaaagaccaagaagcagcugagagagaacgcugaagacaugggcaauggaugcuuuaaaauuuaccacaagugugauaacgccugcauaggcucaauccggaaugggacauaugaccaugacguguaccgagaugaggcucucaacaaucgcuuccaaauuaaaggagucgagcugaagagugguuacaaagacuggauccuuuggauuuccuuugccaucagcugcuuccuguuguguguggcacuccugggcuuuauaaugugggccugccagaaggggaacaucagauguaauauuugcaucuga

SEQ ID NO: 126087 - RNA, 1701 nt, Artificial Sequence
  derived and/or modified sequence opt3 from hemagglutinin__InfluenzaA__ADB90360
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaaacaauggaacuugcuauccaggcgacuuuaucgauuacgaagaacucagggagcagcugagcaguguguccucuuucgaacgguuugagauuuucccgaagacaagcuccuggcccaaccacgacccuaauaagggugucaccgccgcuuguccacaugcaggggccaaaucauuuuauaagaaccugaucuggcucgugaaaaagggaaauaguuaccccaaauuaagcaagucuuauauaaacgauaagggcaaagaaguacugguucuuuggggcauccaccacccuuccacgucagcugaccaacagagcuuguaccagaaugccgaugcguacguguucgucgggaccagucgcuauucuaagaaauuuaagccagagauugcaauccgacccaaagugcguggacaggaggguagaaugaacuacuauuggacucugguggaaccuggcgacaagauuacauucgaggccacugggaaccuagucguuccaagguacgcuuuugccauggaacggaaugcaggauccggcaucauaauuagcgauaccccggugcaugacugcaacacaaccugucaaacgcccaaaggugcuaucaauacuucgcucccuuuccagaacauucacccaaucacaaucgggaagugccccaaguauguaaaaucuaccaagcugcgccuugccacuggacugagaaauauuccuuccauacagucaaggggcuuguuuggcgcgaucgccggguucauugagggagguuggacaggcaugguggaugggugguacggauaucaucaccagaacgaacaaggcagugguuacgcagcugaccucaaaagcacccagaaugccaucgacgagauaacgaacaaggucaauuccgugauugagaaaaugaacacccaguuuacagcuguugggaaggaguucaaucaccuggagaagcggaucgaaaacuuaaauaaaaagguggaugacggcuuccuggauaucuggacuuacaacgccgagcuccuuguccuguuggaaaaugagcgcacccuagacuaucaugauucuaacgugaaaaaccuguacgagaagguacgaagccagcucaaaaauaacgcaaaggaaauuggaaauggcuguuuugaguucuaucacaagugcgacaacacauguauggaaucaguuaaaaaugggacuuacgauuauccaaaguacagugaggaagccaaacugaacagagaggagaucgacggagugaaacuugaauccaccaggauuuaucaaauacuggcuaucuacagcacagucgcgucuucauuggugcucgucgugagucugggugcaauuagcuuuuggaugugcuccaauggcucuuuacagugccggaucuguaucuga

SEQ ID NO: 126088 - RNA, 1701 nt, Artificial Sequence
  derived and/or modified sequence opt3 from hemagglutinin__InfluenzaA__ADB90370
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcguggacaggaggguagaaugaauuacuauuggacucugguggaaccuggcgauaagauuacauucgaggccacugggaaccuagucguuccaagguacgcuuuugccauggaacggaacgcaggauccggcaucauaauuagcgacaccccggugcaugauugcaauacaaccugucaaacgcccaaaggugcuaucaacacuucgcucccuuuccagaauauucacccaaucacaaucgggaagugccccaaguauguaaaaucuaccaagcugcgccuugccacuggacugagaaacgugccuuccauucagucaaggggcuuguuuggcgcgauagccggguucaucgagggagguuggacaggcauggucgacgggugguacggauaucaucaccagaaugaacaaggcagugguuacgcagcugaccucaaaagcacccagaacgccauugaugagaucacgaauaaggugaacuccguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacucuaauguaaagaaccuguacgagaagguucgaagccagcucaaaaacaaugcaaaggaaaucggaaacggcuguuuugaguucuaucacaagugcgauaauacauguauggaaucagugaaaaacgggacuuacgacuauccaaaguacagugaggaagccaaacugaauagagaggagauugauggagucaaacuugaauccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 126089 - RNA, 1701 nt, Artificial Sequence; identical to SEQ ID NO: 125604
  derived and/or modified sequence opt3 from hemagglutinin__InfluenzaA__ADB90414

SEQ ID NO: 126090 - RNA, 1701 nt, Artificial Sequence; identical to SEQ ID NO: 125132
  derived and/or modified sequence opt3 from hemagglutinin__InfluenzaA__ADC32409

SEQ ID NO: 126091 - RNA, 1701 nt, Artificial Sequence
  derived and/or modified sequence opt3 from hemagglutinin__InfluenzaA__ADC32410
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagaaaacccuagacuaucaugauagcaauguaaagaaccuguacgagaaaguucgcucacagcucaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 126092 - RNA, 1701 nt, Artificial Sequence
  derived and/or modified sequence opt3 from hemagglutinin__InfluenzaA__ADC32411
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagagaaaaugaauacccaguuuacagcuguggguaaggaguucaaccaccuggccaagcggauugaaaauuuaaacaaaaaggucgacgauggguuccuggacaucuggacuuacaaugcagagcuccuugugcuguuggaaaacgagcgcacccuagauuaucaugacucaaauguaaagaaccuguacgagaagguucgaagucagcucaaaaacaaugccaaggaaaucggcaacggauguuuugaguucuaucacaagugcgauaauacauguauggaauccgugaaaaacggcacuuacgacuaucccaaguacagcgaggaagcuaaacugaauagagaggagauugauggggucaaacuugaaucuaccaggaucuaucaaauucuggcgauauacucaacaguggcaaguagcuugguccucgugguuucccugggagccaucucuuuuuggaugugcucgaacgguagcuuacagugccggauuuguaucuga

SEQ ID NO: 126093 - RNA, 1701 nt, Artificial Sequence; identical to SEQ ID NO: 125038
  derived and/or modified sequence opt3 from hemagglutinin__InfluenzaA__ADC32412

SEQ ID NO: 126094 - RNA, 1701 nt, Artificial Sequence; identical to SEQ ID NO: 124685
  derived and/or modified sequence opt3 from hemagglutinin__InfluenzaA__ADC32413

SEQ ID NO: 126095 - RNA, 1701 nt, Artificial Sequence; identical to SEQ ID NO: 125132
  derived and/or modified sequence opt3 from hemagglutinin__InfluenzaA__ADC32414

SEQ ID NO: 126096 - RNA, 1701 nt, Artificial Sequence; identical to SEQ ID NO: 125132
  derived and/or modified sequence opt3 from hemagglutinin__InfluenzaA__ADC32415

SEQ ID NO: 126097 - RNA, 1701 nt, Artificial Sequence; identical to SEQ ID NO: 125132
  derived and/or modified sequence opt3 from hemagglutinin__InfluenzaA__ADC32416

SEQ ID NO: 126098 - RNA, 1701 nt, Artificial Sequence
  derived and/or modified sequence opt3 from hemagglutinin__InfluenzaA__ADC32417
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaauacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuucgucagauaacggaacuugcuacccaggcgacuuuaucgauuaugaagaacucagggagcagcugagcaguguguccucuuucgaacgguuugagauuuucccgaagacaagcuccuggcccaaucacgacucaaacaagggugucaccgccgcuuguccucaugcaggggccaaaaguuuuuacaagaaucugaucuggcucgugaaaaagggaaacagcuauccaaaauuaucuaaguccuacauaaaugauaagggcaaagaaguacugguucuuuggggcauccaccaccccucaacgagcgcugaccaacagaguuuguaccagaacgccgaugcguauguguucgucgggacuucucgcuacuccaagaaauuuaagccugagauugcaauccgaccaaaagugcgugagcaggaaggaagaaugaauuauuacuggacccugguggagcccggugacaagauuacauucgaagccacuggcaaccuagucguuccuagguaugcuuuugccauggagcggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgauggcugguauggguaccaucaccagaaugagcaaggaagcggcuacgcagcugaccucaaauccacccagaacgccauugacgagaucacgaauaaggugaacucuguuauagaaaagaugaauacccaguuuacagcuguggguaaggaguucaaccaccuggaaaagcggauugagaauuuaaacaaaaaggucgaugacggguuccuggauaucuggacuuauaaugccgaacuccuugugcuguuggagaacgagcgcacccuagacuaccaugauagcaauguuaaaaaccuguaugaaaagguacgaucacagcucaaaaacaaugcaaaggagaucggcaacggauguuuugaguucuaccacaagugcaauaacacauguauggagagugugaaaaauggcacuuaugacuacccuaaguauuccgaagaggccaaacugaacagagaggaaauugauggggucaaacuugagagcaccaggaucuaccaaauucuggcuauauacucuacaguggcgucaaguuugguccucgugguuagccugggagcaaucuccuuuuggaugugcucuaaugguucguuacagugccggauuuguaucuga

SEQ ID NO: 126099 - RNA, 1701 nt, Artificial Sequence; identical to SEQ ID NO: 125132
  derived and/or modified sequence opt3 from hemagglutinin__InfluenzaA__ADC32418

SEQ ID NO: 126100 - RNA, 1701 nt, Artificial Sequence
  derived and/or modified sequence opt3 from hemagglutinin__InfluenzaA__ADC32419
augaaggccauccuggugguccuccuuuacaccuucgcuacagcaaacgccgacacucugugcauuggauaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguuuggguaccaucaccagaaugaccaaggauccgcauaugcugccgaucucaaaucuacccagaacgcuauugacgagaucacgaauaaggugaacagcguuauagagaaaaugaauacccaguucacagccgugggcaaggaguucaaccaccuggagaagcggauugaaaauuuaaacaaaaaggucgaugacgguuuucuggauaucuggacuuacaaugcagagcuccuugugcuguuggaaaacgagcgcacccuagacuaccaugauucaaauguaaagaaccuguaugagaagguucgaagucagcucaaaaacaaugccaaggaaaucgggaacggcuguuucgaguuuuaccacaagugcgacaauacauguauggaauccgugaaaaacggaacuuaugauuaccccaaguauagcgaggaagcuaaacugaauagagaggagauugacggcgucaaacuugaaucuaccaggaucuaccaaauucuggcgauauauucaacaguggcaaguagcuugguccucgugguuucccugggggccaucucuuucuggaugugcucgaacggcagcuuacagugccggauuuguaucuga

SEQ ID NO: 126101 - RNA, 1701 nt, Artificial Sequence; identical to SEQ ID NO: 125132
  derived and/or modified sequence opt3 from hemagglutinin__InfluenzaA__ADC32420

SEQ ID NO: 126102 - RNA, 1701 nt, Artificial Sequence; identical to SEQ ID NO: 125132
  derived and/or modified sequence opt3 from hemagglutinin__InfluenzaA__ADC32421

SEQ ID NO: 126103 - RNA, 1701 nt, Artificial Sequence
  derived and/or modified sequence opt3 from hemagglutinin__InfluenzaA__ADC32422
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuaauggucccuagguacgcuuuugccauggagcggaacgcagggagcggaaucauaauuucggacaccccaguucaugauugcaauacaaccugucaaacgccgaaaggcgcuaucaacacuucucuccccuuccagaauauucacuccaucacaaucgguaagugcccuaaguaugugaaaucaaccaagcugcgccuugccacugggcugagaaacguaccaaguauucagagcaggggauuguuuggcgcgauagccggcuucaucgaagggggauggacagguaugguggacggcugguacggguaucaucaccagaaugagcaaggauccggcuacgcagcugaccucaaaucuacccagaacgccauugaugagaucacgaauaaggucaacagcgugauagaaaagaugaauacccaguuuacagcuguugguaaggaguucaaccaccuggaaaagcggauugagaauuuaaacaaaaagguggacgauggguuccuggacaucuggacuuacaaugccgaacuccuuguccuguuggagaacgagcgcacccuagauuaucaugacucaaaugugaaaaaccuguacgaaaagguacgaagucagcucaaaaacaaugcaaaggagaucggcaacggauguuuugaguucuaucacaagugcgauaauacauguauggaguccguuaaaaacggcacuuacgacuaucccaaguacagcgaagaggccaaacugaauagagaggaaauugauggggugaaacuugagucuaccaggaucuaucaaauucuggcuauauacucaacagucgcgaguagcuuggugcucgucgugucccugggagcaaucucuuuuuggaugugcucgaacgguagcuuacagugccggauuuguaucuga

SEQ ID NO: 126104 - RNA, 1701 nt, Artificial Sequence
  derived and/or modified sequence opt3 from hemagglutinin__InfluenzaA__ADC32423
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucaaugacggguuccuggauaucuggacuuacaacgccgaacuccuugugcuguuggagaaugagcgcacccuagacuaucaugauucaaacguuaaaaaccuguacgaaaagguacgaagucagcucaaaaauaacgcaaaggagaucggcaauggauguuuugaguucuaucacaagugcgacaacacauguauggaguccgugaaaaauggcacuuacgauuaucccaaguacagcgaagaggccaaacugaacagagaggaaauugacggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 126105 - RNA, 1701 nt, Artificial Sequence
  derived and/or modified sequence opt3 from hemagglutinin__InfluenzaA__ADC32434
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagcacgccauugacgagaucacgaacaagguaaauucuguuauagagaaaaugaacacccaguuuacagcuguggguaaggaguucaaucaucuggaaaagcggauugaaaacuuaaauaaaaaggucgaugacggguuccuggauaucuggacuuacaacgccgagcuccuugugcuguuggaaaaugagcgcacccuagacuaucacgauagcaacgugaaaaaucuguacgagaagguucgaucacagcucaaaaacaacgcaaaggaaaucggcaauggauguuuugaguucuaucauaagugcgacaacacauguauggaaagugugaaaaauggcacuuacgauuauccuaaguacuccgaggaagccaaacugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126106 - RNA, 1701 nt, Artificial Sequence; identical to SEQ ID NO: 126105
  derived and/or modified sequence opt3 from hemagglutinin__InfluenzaA__ADC32435

SEQ ID NO: 126107 - RNA, 1701 nt, Artificial Sequence
  derived and/or modified sequence opt3 from hemagglutinin__InfluenzaA__ADC34940
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaacgguucaacuggacagggguuacccagaauggaacguccucugcuugcaagcgcggcagcgacaacuccuuuuucucacgacugaauuggcucacucauuuaaaguuuaaauauccagcacugaacgugaccaugcccaauaacgagaaguucgauaaacuuuacaucuggggcguccaccauccugggacagacaacgaucagaucuuuuugcacgcccaggcuaguggacguauuacugugagcaccaagagaucucaacagacaguaauuccaaauaucgguuccaggccccggguucgcaacauaccuucaagaauuagcaucuauuggaccauugugaaaccaggcgacauccugcuaaucaauaguacggggaaccucauugccccgaggggauacuucaagauacggucuggcaaguccagcaucaugaaaucggacgcgcccauugguaaguguaauucugagugcaucacuccuaacggguccauaccaaaugauaaacccuuucagaacgucaaucgcauuacauacggagcauguccucgauaugugaagcagaacacccugaaacuugccacuggcaugagaaaugugccagaaaagcaaacaaggggcaucuucggggcuaucgccggauuuauugagaacgguugggaaggcauggucgacgggugguacggauuccggcaccaaaauucagagggcaucggucaggcagcugaucugaaaaguacccaggccgcgauuaaccagauaaaugggaaguugaaccgucucaucggcaagacgaacgagaaauuccaucagauugaaaaggaguuuagcgaaguugagggacgcauccaggaccuggaaaaauauguggaggauaccaagaucgacuuaugguccuacaaugccgagcugcucguagcacuugaaaaccaacacacaauugaucugacugacucugagaugaauaaauuguucgaaagaaccaagaagcagcuaagggagaacgcugaagauaugggcaaugggugcuuuaaaauauaucauaagugugacaacgccugcaucggaagcauucggaaugguacauacgaucacgacguguaucgagacgaggcucugaacaaucgcuuccagaucaaaggcgucgagcucaagucaggguacaaagauuggauucuguggaucaguuuugccauauccugcuuccuucuguguguggcauugcucggauuuaucaugugggccugccagaagggcaacauuagauguaauaucugcauuuga

SEQ ID NO: 126108 - RNA, 1701 nt, Artificial Sequence; identical to SEQ ID NO: 126020
  derived and/or modified sequence opt3 from hemagglutinin__InfluenzaA__ADC38987

SEQ ID NO: 126109 - RNA, 1701 nt, Artificial Sequence
  derived and/or modified sequence opt3 from hemagglutinin__InfluenzaA__ADC38997
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagauguacugguucuuuggggcauccaccaccccucaacgagcgcugaccaacagaguuuguaccagaacgccgaugcguacguguucgucgggacuucucgcuauuccaagaaauuuaagccugaaauugcaauccgaccaaaagugcgugaccaggagggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgauggcugguacggguaucaucaccagaaugagcaaggaagcggcuacgcagcugaccucaaauccacccagaacgccauugaugaaaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgaacgcacccuagauuaucaugacagcaauguaaagaaccuguacgagaagguucgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaagagauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126110 - RNA, 1701 nt, Artificial Sequence; identical to SEQ ID NO: 125786
  derived and/or modified sequence opt3 from hemagglutinin__InfluenzaA__ADC39007

SEQ ID NO: 126111 - RNA, 1698 nt, Artificial Sequence
  derived and/or modified sequence opt3 from hemagglutinin__InfluenzaA__ADC45604
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaaaacucucacaaugggaaacuaugccuccugaagggaauagcgccccuucagcuggguaacuguucagucgcuggcuggaucuuggggaauccugagugcgaacuccugauuaguaaagagagcugguccuacaucguggaaaagccaaacccggagaauggaaccuguuaucccggccauuuugccgauuacgaggaacugagagagcaacucucuucgguuagcucauucgaaagguuugagauuuucccuaaggagaguuccuggccaaaccacacugugacaggugucucugcaagcugcucccauaauggggaaucaaguuuuuaucggaacuuacuguggcuuaccggcaaaaauggauuguaccccaaccugagcaagucuuaugccaauaacaaagagaaggaagugcuaguacucuggggcguucaccacccuccaaacaucggggaccagaaagcucuguaccauacggagaaugcauacguguccgucgugucaagccacuauagucgcaaguucacucccgaaauagccaagcgaccuaaagugcgugaucaggagggaagaaucaacuacuauuggacccuucuggagccaggugacacaauuaucuuugaagcuaauggcaacuugauugccccgagguacgcguucgcacucucucgggggcugggauccggcaucauaaauagcaacgcccccauggauaagugugacgcuaaaugccagacuccucaaggugccauuaauucgucuuuaccauuucagaacguccaucccguuaccaucggggaguguccuaaguaugugcgcuccgcaaaacugagaaugguaacaggacucaggaauauuccaucaauccagagucggggccuuuucggcgcuaucgccggguuuauugaaggagguuggaccggcaugguggaugggugguacggauaucaccaccagaacgagcaaggcagcgguuacgcggccgaccagaaguccacgcagaaugcaauaaacgggaucacuaauaaagucaacucugugauugaaaagaugaauacacaguucaccgcuguuggcaaggaguuuaacaaacuggagcgccgaauggaaaacuugaauaagaaaguggaugacggauucaucgauauauggacuuacaacgccgagcuacugguccuccuggaaaaugagagaacacuugacuuccaugacagcaacgugaagaaucuguaugaaaaaguaaagucacaauugaagaacaaugcuaaagagauuggcaacgggugcuuugaguucuaccacaaguguaaugaugaaugcauggagaguguuaaaaacggaaccuaugacuaccccaaguauuccgaagagagcaaacucaauagggagaagaucgauggugugaagcuggaaucuaugggcgucuaccagaucuuagccauuuauucaacgguggcaaguagccugguccuacucgugucccugggggccaucucuuuuuggaugugcucgaacggaagccuucagugucggauuugcauauga

SEQ ID NO: 126112 - RNA, 1698 nt, Artificial Sequence
  derived and/or modified sequence opt3 from hemagglutinin__InfluenzaA__ADC45626
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaaguucuaguacucuggggcgugcaccacccuccaaacaucgggaaucagaugacgcuguaccauaaggagaacgccuacgucucugugguguccucacacuauagccggaaguucacucccgaaauagcuaaacgcccuaagguccgagaucaggagggacguaucaauuacuauuggacccuucuggagccaggugacacaauuaucuuugaagcaaguggcaacuugauugccccgagauacgcuuucgcccucucuaggggguuuggauccggcaucauaaauagcaacgcgcccauggaugagugugacgcaaaaugccagacuccucaaggugccauuaauucgucucugccauuccagaacguucaucccgugaccaucggggaauguccuaaguauguacgguccgcuaaauuacgcauggugacaggacugagaaauauuccaucaauccagaguaggggccucuuuggcgccaucgcaggguucauugagggagguuggaccggcauggucgaugggugguacggauaucaccaccagaacgaacaaggcagcgguuacgcugccgaccagaaguccacgcagaaugcgauaaacgggaucacuaauaaagugaacucuguuauugagaagaugaauacacaguuuaccgccgugggcaaggaguucaacaaacuugaacggcgcauggagaaccugaauaagaaagucgaugacggauucaucgauguguggacuuacaacgcagaauugcuaguacugcucgagaaugaacgaacacuggacuuucaugacagcaacguuaagaaucuuuaugagaaagugaagaaccaacugaagaauaacgcuaaagagauaggcaaugggugcuucgaauuuuaccacaaguguaacgaugagugcauggaaucagucaaaaauggaaccuaugacuaccccaaguauagugaggaguccaaauugagcagagaaaagauugauggugugaagcucgagucuaugggcgucuaccagauccuggccaucuauucaacgguggcuaguagcuuaguucugcuagugucccucggggccauuucuuucuggaugugcucgaacggaagccugcaguguaggaucugcauuuga

SEQ ID NO: 126113 - RNA, 1698 nt, Artificial Sequence
  derived and/or modified sequence opt3 from hemagglutinin__InfluenzaA__ADC45637
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaagugcuaguucucuggggcgugcaccacccuccaaacaucggggaucagaugacgcuguaccauaaggagaaugccuacgucucugugguguccucacacuauagccggaaguucacucccgaaauagcuaaacgcccuaagguccgagaccaggagggacguaucaacuacuauuggacccuucuggagccaggugauacaauuaucuuugaagcaaguggcaauuugauugccccgagauacgcuuucgcccucucuaggggguuuggauccggcaucauaaacagcaaugcgcccauggacgagugugaugcaaaaugccagacuccucaaggugccauuaacucgucucugccauuccagaauguucaucccgugaccaucggggaauguccuaaguauguacgguccgcuaaauuacgcauggugacaggacugagaaacauuccaucaauccagaguaggggccucuuuggcgccaucgcaggguucauugagggagguuggaccggcauggucgacgggugguacggauaucaccaccagaaugaacaaggcagcgguuacgcugccgaucagaaguccacgcagaacgcgauaaaugggaucacuaacaaaguaaauucuguuauugagaagaugaacacacaguuuaccgccgugggcaaggaguucaauaaacuugaacggcgcauggagaaccugaacaagaaagucgacgauggauucaucgacguguggacuuacaaugcagaauugcuaguacugcucgagaacgaacgaacacuggacuuucaugauagcaauguuaagaaccuuuaugagaaagugaagaaucaacugaagaacaaugcuaaagagauaggcaacgggugcuucgaauuuuaccacaaguguaaugacgagugcauggaaucagucaaaaacggaaccuaugauuaccccaaguauagugaggaguccaaauugagcagagaaaagauugacggugugaagcucgagucuaugggcgucuaccagauccuggccaucuauucaacgguggcuaguagcuuaguucugcuagugucccucggggccauuucuuucuggaugugcucgaauggaagccugcaguguaggaucugcauuuga

SEQ ID NO: 126114 - RNA, 1698 nt, Artificial Sequence
  derived and/or modified sequence opt3 from hemagglutinin__InfluenzaA__ADC45648
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaaucgcuggcuggguguuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacaggcaaaaauggauuguaccccaaccugagcaagucuuaugccaauaacaaagagaaggaaguucuaguacucuggggcgugcaccacccuccaaacaucggggaccagaaagcucuguaccauaccgagaaugcauacgucuccguggugucaagccacuauagucgcaaguucacgcccgaaauagccaagcgaccuaaaguccgugaucaggagggaagaaucaacuacuauuggacucuucuggagccaggugacaccauuaucuuugaagcuaauggcaacuugauugccccgagguacgcguucgcacucucucggggguuuggauccggcaucauaaauagcaacgcccccauggauaagugugacgcuaaaugccagacaccucaaggugccauuaauucgucucugccauuccagaacguucaucccgugacuaucggggaguguccuaaguauguacgcuccgcaaaauuaagaauggugaccggacugaggaauauuccaucaauccagagucggggccucuuuggcgcuaucgccggguucauugaaggagguuggacaggcauggucgaugggugguacggauaucaccaccagaacgagcaaggcagcgguuacgcggccgaccagaaguccacccagaaugcaauaaacgggaucacgaauaaagugaacucuguuauugaaaagaugaauacucaguuuacagcugugggcaaggaguucaacaaacuugagcgccgaauggaaaaccugaauaagaaagucgaugacggauucaucgauauauggaccuacaacgccgaguugcuagugcugcucgaaaaugagagaacucuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacauaugacuaccccaaguauuccgaagagagcaaauugaauagggagaagaucgauggugucaagcucgaaucuaugggcguguaccagauccuggccauuuauucaaccgucgcaaguagcuuagugcugcuaguuucccucggggccaucucuuucuggaugugcucgaacggaagccugcagugucggauuugcauauga

SEQ ID NO: 126115 - RNA, 1698 nt, Artificial Sequence
  derived and/or modified sequence opt3 from hemagglutinin__InfluenzaA__ADC45659
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaagaaaaguuccuggccaaaccacacugucacaggugugucugccagcugcucccauaauggggagucaaguuuuuaucggaacuuacuguggcuuaccgaaaagaauggauuguaccccaaccugagcaaaucuuaugcaaauaacaaggagaaagaaguucuaguacucuggggcgugcaccacccuccaaacaucggcgaccagaaggcccuguaccauacggagaaugcuuacgucuccguggugucaagccacuauagucgcaaguucacucccgaaauagcaaaacgaccuaagguccgugaucaggaggggagaaucaacuacuauuggacccuucuggagccaggagacacaauuaucuuugaagccaaugguaacuugauugcuccgagguacgccuucgcgcucucucggggcuuuggguccggaaucauaaauagcaacgcacccauggauaaaugugacgccaagugccagacuccucaaggcgcuauuaauucgucucugccauuccagaacguucaucccgugaccaucggugaguguccuaaauauguacgcuccgccaaguuaagaauggugacagggcugaggaauauuccaucaauccagagucggggacucuuuggcgcaaucgcuggcuucauugaagggggauggaccgguauggucgauggcugguacggguaucaccaccagaacgagcaaggaagcggcuacgccgcggaccagaaauccacgcagaaugccauaaacgguaucacuaauaaggugaacucuguuauugaaaagaugaauacacaguuuaccgcaguggggaaagaguucaacaaacuugagcgccgaauggaaaaccugaauaaaaaggucgaugacggcuucaucgauauauggacuuacaacgcugaguugcuagugcugcucgaaaaugagagaacacuggacuuucaugacagcaacguaaagaaucuuuaugaaaagguuaagucacaacugaaaaacaaugccaaggagauuggaaacggcugcuucgaguuuuaccacaaauguaaugaugaaugcauggagagugugaagaacgggaccuaugacuaccccaaauauuccgaagagagcaaguugaauagggagaagaucgauggagucaaacucgaaucuauggguguguaccagauccuggcuauuuauucaacggucgccaguagcuuagugcugcuaguuucccucggcgcaaucucuuucuggaugugcucgaacgggagccugcagugucggauuugcauauga

SEQ ID NO: 126116 - RNA, 1698 nt, Artificial Sequence
  derived and/or modified sequence opt3 from hemagglutinin__InfluenzaA__ADC45670
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugggucugccagcugcucccauaauggagaaucaaguuuuuaucggaacuuacuguggcuuaccggcaaaaauggcuuguaccccaaccugagcaagucuuaugcaaauaacaaagagaaggaagugcuaguacucuggggaguucaccacccuccaaacaucggggaccagaaagcccuguaccauacggagaaugcuuacguguccgucgugucaagccacuauagucgcaaguucacucccgaaauagcaaagcgaccuaaagugcgugaucaggaggguagaaucaacuacuauuggacccuucuggagccaggcgacacaauuaucuuugaagccaaugggaacuugauugcuccgagguacgccuucgcgcucucucggggauuuggcuccgguaucauaaauagcaacgcacccauggauaagugugacgccaaaugccagacuccucaaggggcuauuaauucgucucugccauuccagaacguccaucccguuaccaucggagaguguccuaaguaugugcgcuccgccaaauuaagaaugguaacaggccugaggaauauuccaucaauccagagucggggccucuuuggggcaaucgcuggauucauugaagguggcuggaccgggaugguggauggaugguacggcuaucaccaccagaacgagcaagguagcggguacgccgcggaccagaaguccacgcagaaugccauaaacggcaucacuaauaaagucaacucugugauugaaaagaugaauacacaguuuaccgcaguuggaaaggaguucaacaaacuugagcgccgaauggaaaaccugaauaagaaaguggaugacggcuucaucgauauauggacuuacaacgcugaguugcuaguccugcucgaaaaugagagaacacuggacuuucaugacagcaacgugaagaaucuuuaugaaaaaguaaagucacaacugaagaacaaugccaaagagauugggaacggaugcuucgaguuuuaccacaaguguaaugaugaaugcauggagaguguuaaaaacgguaccuaugacuaccccaaguauuccgaagagagcaaauugaauagggagaagaucgauggcgugaagcucgaaucuaugggggucuaccagauccuggcuauuuauucaacgguggccaguagcuuaguccugcuagugucccucggagcaaucucuuucuggaugugcucgaacggcagccugcagugucggauuugcauauga

SEQ ID NO: 126117 - RNA, 1698 nt, Artificial Sequence
  derived and/or modified sequence opt3 from hemagglutinin__InfluenzaA__ADC45681
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugccucgucauucgaaagguuugagauuuucccuaaggagagcaguuggccaaaccacacugugacaggugucuccgcaucuugcagccauaauggggaauccucauuuuauaaaaacuuacuguggcuuaccggaaagaauggcuuguaccccaaccugcggaaaaguuaugccaauaacaaggagaaagaagugcuaguacucuggggcguucaccacccuccaaacaucggggaucagaugacgcuguaccauaaggagaaugcuuacgugagcgucgugucuucccacuauucacgcaaguucacucccgaaauagcaaaacgaccuaaggugcgugaccaggagggaagaaucaacuacuauuggacccuucuggagccaggugauacaauuaucuuugaagccagcggcaauuugauugcuccgagguacgccuucgcgcucagucggggguuuggaucuggcaucauaaacuccaaugcacccauggacgagugugaugccaaaugccagacuccucaaggugcuauuaacagcucgcugccauuccagaauguccaucccguuaccaucggggaauguccuaaguaugugcgcucugccaaauuaagaaugguaacaggacugaggaacauuccauccauccagucacggggccucuuuggcgcaaucgcuggguucauugagggagguuggaccggcaugguggacgggugguacggauaucaccaccagaaugaacaaggcagugguuacgccgcggaucaaaagagcacgcagaacgccauaaaugggaucacuaacaaagucaauuccgugauugagaagaugaacacacaguuuaccgcaguuggcaaggaguucaauaaacuugaacgccgaauggagaaccugaacaagaaaguggacgauggauucaucgacgucuggacuuacaaugcugaauugcuagugcugcucgagaacgaaagaacacuggacuuucaugauucuaauguaaagaaccuuuaugagaaaguuaagaaucagcugaagaacaaugccaaagagauaggcaacgggugcuucgaauuuuaccacaaguguaaugacgagugcauggaaagcgugaaaaacggaaccuaugauuaccccaaguauucagaggagaguaaauuguccagggaaaagauugacggugucaagcucgagagcaugggcguguaccagauccuggcuaucuauucuacggucgccucaaguuuagugcugcuaguuagccucggggcaauuuccuucuggaugugcucuaauggaucgcugcagugucggaucugcauuuga

SEQ ID NO: 126118 - RNA, 1698 nt, Artificial Sequence
  derived and/or modified sequence opt3 from hemagglutinin__InfluenzaA__ADC45692
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaaaagagcugguccuacaucguugagaagccaaacccggaaaauggaaccuguuaucccggccauuuugcugauuacgaggagcugagagaacaacucucuucggugagcucauucgagagguuugaaauuuucccuaaagagaguuccuggccaaaccacacugucacaggugugucugccagcugcucccauaauggggagucaaguuuuuaucggaacuuacuguggcuuaccggaaagaauggcuuguaccccaaccugagcaaaucuuaugcaaauaacaaggaaaaagagguucuaguacucuggggcgugcaccacccuccaaacaucggggaccagaaggcccuguaccauacggaaaaugcuuacgucuccguggugucaagccacuauagucgcaaguucacucccgagauagcaaaacgaccuaagguccgugaucaggaaggaagaaucaacuacuauuggacccuucuggagccaggugacacaauuaucuuugaggccaauggcaacuugauugcuccgagguacgccuucgcgcucucucggggguuuggauccggcaucauaaauagcaacgcacccauggauaaaugugacgccaagugccagacuccucaaggugcuauuaauucgucucugccauuccagaacguucaucccgugaccaucggggaauguccuaaauauguacgcuccgccaaguuaagaauggugacaggacugaggaauauuccaucaauccagagucggggccucuuuggcgcaaucgcuggguucauugagggagguuggaccggcauggucgaugggugguacggauaucaccaccagaacgaacaaggcagcgguuacgccgcggaccagaaauccacgcagaaugccauaaacgggaucacuaauaaggugaacucuguuauugagaagaugaauacacaguuuaccgcagugggcaaagaguucaacaaacuugaacgccgaauggagaaccugaauaaaaaggucgaugacggauucaucgauauauggacuuacaacgcugaauugcuagugcugcucgagaaugaaagaacacuggacuuucaugacagcaacguaaagaaucuuuaugagaagguuaagucacaacugaaaaacaaugccaaggaaauuggcaacgggugcuucgaguuuuaccacaaauguaaugaugagugcauggaaagugugaagaacggaaccuaugacuaccccaaauauuccgaggaaagcaaguugaauagggagaagaucgauggugucaaacucgagucuaugggcguguaccagauccuggcuauuuauucaacggucgccaguagcuuagugcugcuaguuucccucggggcaaucucuuucuggaugugcucgaacggaagccugcagugucggauuugcauauga

SEQ ID NO: 126119 - RNA, 1698 nt, Artificial Sequence; identical to SEQ ID NO: 125186
  derived and/or modified sequence opt3 from hemagglutinin__InfluenzaA__ADC45703

SEQ ID NO: 126120 - RNA, 1698 nt, Artificial Sequence
  derived and/or modified sequence opt3 from hemagglutinin__InfluenzaA__ADC45714
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaagugcuaguucucuggggcgugcaccacccuccaaacaucggggaucagacgacucuguaccauaaggagaaugccuacgucucugugguguccucacacuauagccggaaguucacccccgaaauagcuaaacgcccuaagguccgagaccaggagggacguaucaacuacuauuggacacuucuggagccaggugauacuauuaucuuugaagcaaguggcaauuugauugccccgagauacgcuuucgcccucucuaggggguuuggauccggcaucauaaacagcaaugcgcccauggacgagugugaugcaaaaugccagaccccucaaggugccauuaacucgucucugccauuccagaauguucaucccgugacaaucggggaauguccuaaguauguacgguccgcuaaauuacgcauggugaccggacugagaaacauuccaucaauccagaguaggggccucuuuggcgccaucgcaggguucauugagggagguuggacgggcauggucgacgggugguacggauaucaccaccagaaugaacaaggcagcgguuacgcugccgaucagaaguccacucagaacgcgauaaaugggaucacaaacaaaguaaauucuguuauugagaagaugaacacccaguuuacugccgugggcaaggaguucaauaaacuugaacggcgcauggagaaccugaacaagaaagucgacgauggauucaucgacguguggacauacaaugcagaauugcuaguacugcucgagaacgaacgaacccuggacuuucaugauagcaauguuaagaaccuuuaugagaaagugaagaaucaacugaagaacaaugcuaaagagauaggcaacgggugcuucgaauuuuaccacaaguguaaugacgagugcauggaaucagucaaaaacggaacguaugauuaccccaaguauagugaggaguccaaauugagcagagaaaagauugacggugugaagcucgagucuaugggcgucuaccagauccuggccaucuauucaaccguggcuaguagcuuaguucugcuagugucccucggggccauuucuuucuggaugugcucgaauggaagccugcaguguaggaucugcauuuga

SEQ ID NO: 126121 - RNA, 1698 nt, Artificial Sequence; identical to SEQ ID NO: 125186
  derived and/or modified sequence opt3 from hemagglutinin__InfluenzaA__ADC45725

SEQ ID NO: 126122 - RNA, 1698 nt, Artificial Sequence
  derived and/or modified sequence opt3 from hemagglutinin__InfluenzaA__ADC45736
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaauacuuacgucuccguggugucaagccacuauagucgcaaguucacccccgaaauagcuaagcgaccuaaaguccgugaucaggagggaagaaucaacuacuauuggacacuucuggagccaggugacacuauuaucuuugaagcaaauggcaacuugauugccccgagguacgcuuucgcccucucucggggguuuggauccggcaucauaaauagcaacgcgcccauggauaagugugacgcaaaaugccagaccccucaaggugccauuaauucgucucugccauuccagaacguucaucccgugacaaucggggaguguccuaaguauguacgcuccgcuaaauuaagaauggugaccggacugaggaauauuccaucaauccagagucggggccucuuuggcgccaucgcaggguucauugaaggagguuggacgggcauggucgaugggugguacggauaucaccaccagaacgagcaaggcagcgguuacgcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacguaugacuaccccaaguauuccgaagagagcaaauugaauagggagaagaucgauggugucaagcucgaaucuaugggcguguaccagauccuggccauuuauucaaccgucgcuaguagcuuagugcugcuaguuucccucggggccaucucuuucuggaugugcucgaacggaagccugcagugucggauuugcauauga

SEQ ID NO: 126123 - RNA, 1698 nt, Artificial Sequence; identical to SEQ ID NO: 124504
  derived and/or modified sequence opt3 from hemagglutinin__InfluenzaA__ADC45747

SEQ ID NO: 126124 - RNA, 1698 nt, Artificial Sequence
  derived and/or modified sequence opt3 from hemagglutinin__InfluenzaA__ADC45758
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacgccaaaugccagaccccucaaggcgcuauuaacagcucgcugccauuccagaauguucaucccgugacaaucggugaguguccuaaguauguacgcucugccaaauuaagaauggugaccgggcugaggaacauuccauccauccagucacggggacucuuuggcgcaaucgcuggcuucauugaagggggauggacggguauggucgauggcugguacggguaucaccaccagaaugagcaaggaaguggcuacgccgcggaccagaaaagcacucagaacgccauaaaugguaucacaaacaaaguaaauuccguuauugaaaagaugaacacccaguuuacugcaguggggaaggaguucaacaaacuugagcgccgaauggaaaaucugaacaagaaagucgaugacggcuucaucgauauauggacauacaaugcugaguugcuagugcugcucgaaaacgagagaacccugaauuuucaugacucuaacguaaagaaucuuuaugaaaaaguuaagagccaacugaagaacaaugccaaagagauuggaaacggcugcuucgaguuuuaccacaaguguaaugacgaaugcauggagucagugaaaaacgggacguaugauuaccccaaguauagugaagaguccaaauugaauagggagaagaucgacggagucaagcucgaaagcauggguguguaccagauccuggcuauuuauucuaccgucgccucaaguuuagugcugcuaguuagccucggcgcaaucuccuucuggaugugcucuaacgggucgcugcagugucggauuugcauauga

SEQ ID NO: 126125 - RNA, 1698 nt, Artificial Sequence; identical to SEQ ID NO: 125642
  derived and/or modified sequence opt3 from hemagglutinin__InfluenzaA__ADC45780

SEQ ID NO: 126126 - RNA, 1698 nt, Artificial Sequence; identical to SEQ ID NO: 125147
  derived and/or modified sequence opt3 from hemagglutinin__InfluenzaA__ADC45791

SEQ ID NO: 126127 - RNA, 1698 nt, Artificial Sequence
  derived and/or modified sequence opt3 from hemagglutinin__InfluenzaA__ADC45813
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaaaacucucacaaugggaaacuaugccuccugaagggaaucgcgccccuucagcuggguaacuguucagucgccggcuggauuuuggggaauccugagugcgaacuccugaucaguaaagagagcugguccuacauuguggaaaagccaaacccggagaauggaaccuguuaucccggccauuuugcugauuacgaggaacugagagagcaacucucuucgguuagcucauucgaaagguuugagaucuucccuaaggagaguuccuggccaaaccacacugugacaggugucucugccagcugcucccauaauggggaaucaaguuuuuaucggaacuuacuguggcuuaccaugaaaaauggauuguaccccaaccugagcaagucuuaugcaaauaacaaagagaaggaagugcuaguacucuggggcguucaccacccuccaaacauaggcgaccagaaaacgcuguacaauacugagaacgccuacguguccgucgugucaagccauuauagucgcaaguucacccccgaaaucgcuaagcgaccuaaagugcgugaucaggaggggagaauuaauuacuauuggacacuucuggagccaggagacacuaucauuuuugaagcaaacgguaauuugaucgccccgagguacgcuuucgcccucucucggggcuuuggguccggaauaauuaacagcaaugcgcccauggauaagugugacgcaaaaugccagaccccucaaggcgccaucaacucgucucugccauuccagaauguccaccccguuacaauuggugaguguccuaaguaugugcgcuccgcuaaauuaagaaugguaaccgggcugaggaacaucccaucaauccagagucggggacucuuuggcgccauugcaggcuucauagaagggggauggacggguaugguggauggcugguacggguaucaucaccagaaugagcaaggaagcggcuacgcugccgaccagaaguccacucagaacgcgaucaaugguauuacaaacaaagucaauucugugaucgaaaagaugaacacccaguuuacugccguugggaaggaguucaacaaacuugagcgccgaauggaaaaucugaacaagaaaguggaugacggcuucauagauauuuggacauacaaugcagaguugcuaguccugcucgaaaacgagagaacccuggacuuucacgacagcaaugugaagaaccuuuaugaaaaaguaaagucacaacugaagaauaacgcuaaagagaucggaaauggcugcuucgaguuuuaccauaaguguaacgaugaaugcauggagaguguuaaaaaugggacguaugacuaccccaaguauuccgaagagagcaaauugaacagggagaagaucgauggagugaagcucgaaucuaugggugucuaccagauucuggccaucuauucaaccguggcuaguagcuuaguccugcuagugucccucggcgccauuucuuucuggaugugcucgaaugggagccugcagugucggauaugcaucuga

SEQ ID NO: 126128 - RNA, 1698 nt, Artificial Sequence; identical to SEQ ID NO: 125147
  derived and/or modified sequence opt3 from hemagglutinin__InfluenzaA__ADC45824

SEQ ID NO: 126129 - RNA, 1698 nt, Artificial Sequence
  derived and/or modified sequence opt3 from hemagglutinin__InfluenzaA__ADC45835
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacgccaaaugccagaccccucaaggcgcuauuaacagcucgcugccauuccagaauguucaucccgugacaaucggugaguguccuaaguauguacgcucugccaaauuaagaauggugaccgggcugaggaacauuccauccauccagucacggggacucuuuggcgcaaucgcuggcuucauugaagggggauggacggguauggucgauggcugguacggguaucaccaccagaaugagcaaggaaguggcuacgccgcggaccagaaaagcacucagaacgccauaaaugguaucacaaacaaaguaaauuccguuauugaaaagaugaacacccaguuuacugcaguggggaaggaguucaacaaacuugagcgccgaauggaaaaucugaacaagaaagucgaugacggcuucaucgauauauggacauacaaugcugaguugcuagugcugcucgaaaacgagagaacccuggacuuucaugacucuaauguaaagaaccuuuaugaaaaaguuaagagccaacugaagaauaacgccaaagagauuggaaauggcugcuucgaguuuuaccacaaguguaacgaugaaugcauggagucagugaaaaaugggacguaugacuaccccaaguauagugaagaguccaaauugaacagggagaagaucgauggagucacccucgaaagcauggguguguaccagauccuggcuauuuauucuacagucgccucaaguuuagugcugcuaguuagccucggcgcaaucuccuucuggaugugcucuaaugggucgcugcagugucggauuugcauauga

SEQ ID NO: 126130 - RNA, 1698 nt, Artificial Sequence; identical to SEQ ID NO: 124504
  derived and/or modified sequence opt3 from hemagglutinin__InfluenzaA__ADC45846

SEQ ID NO: 126131 - RNA, 1701 nt, Artificial Sequence; identical to SEQ ID NO: 124685
  derived and/or modified sequence opt3 from hemagglutinin__InfluenzaA__ADC53558

SEQ ID NO: 126132 - RNA, 1701 nt, Artificial Sequence; identical to SEQ ID NO: 124776
  derived and/or modified sequence opt3 from hemagglutinin__InfluenzaA__ADD14087

SEQ ID NO: 126133 - RNA, 1701 nt, Artificial Sequence; identical to SEQ ID NO: 124685
  derived and/or modified sequence opt3 from hemagglutinin__InfluenzaA__ADD14089

SEQ ID NO: 126134 - RNA, 1701 nt, Artificial Sequence; identical to SEQ ID NO: 124685
  derived and/or modified sequence opt3 from hemagglutinin__InfluenzaA__ADD14093

SEQ ID NO: 126135 - RNA, 1701 nt, Artificial Sequence
  derived and/or modified sequence opt3 from hemagglutinin__InfluenzaA__ADD14095
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuaguccucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggacggcugguacggguaucaucaccagaaugaacaaggaagcggcuacgcagcugaucugaaguccacccagaacgccauugacgagaucacgaauaaggucaacucugugauagagaaaaugaauacccaguuuacagcuguugguaaggaguucaaccacuuagaaaagcggauugaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacuuaauagagaggagauugacggggugaagcuggaaagcaccaggaucuaucaaauuuuggcuauauacucuacagucgcgucaagucucgugcuggucgugagcuuaggagcaaucuccuuuuggaugugcucuaacgguucgcugcagugccggauuuguaucuga

SEQ ID NO: 126136 - RNA, 1701 nt, Artificial Sequence; identical to SEQ ID NO: 124685
  derived and/or modified sequence opt3 from hemagglutinin__InfluenzaA__ADD14097

SEQ ID NO: 126137 - RNA, 1701 nt, Artificial Sequence; identical to SEQ ID NO: 124685
  derived and/or modified sequence opt3 from hemagglutinin__InfluenzaA__ADD14099

SEQ ID NO: 126138 - RNA, 1701 nt, Artificial Sequence; identical to SEQ ID NO: 124685
  derived and/or modified sequence opt3 from hemagglutinin__InfluenzaA__ADD14101

SEQ ID NO: 126139 - RNA, 1701 nt, Artificial Sequence
  derived and/or modified sequence opt3 from hemagglutinin__InfluenzaA__ADD14103
augaaggccauccuggugguccuccuuugcaccuucgcuacagcaaacgccgacacucuguguauuggcuaccacgcgaauaacagcacggauaccguugacacaguguuggagaagaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaagaacucagggagcagcugagcaguguguccucuuucgaacgguuugagauuuucccgaagacaagcuccuggcccaaucacgauucaaacaagggugucaccgccgcuugcccucaugcaggggccaaaaguuuuuacaagaaucugaucuggcucgugaaaaagggaaacagcuauccaaaauuaucuaaguccuacauaaaugacaagggcaaagaaguacugguucuuuggggcauccaccaccccucaacgagcgcugaucaacagaguuuguaucagaacgccgacgcguacguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcaugacuguaauacaaccugccaaacgccgaaaggcgcuaucaacacuucucuccccuuccagaauauucacccuaucacaaucgguaaguguccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaucaccagaaugaacaaggaagcggcuaugcagcugaucucaaauccacccagaacgccauugacgagaucacgaauaaggugaacucuguuauagagaaaaugaauacccaguuuacagcuguggguaaggaguucaaccaccuggauaagcggauugagaauuuaaacaaaaagaucgacgauggguuccuggacaucuggacuuacaaugccgaacuccuuguccuguuggagaacgaacgcacccuagauuaccaugacagcaaugugaaaaaccuguaugagaagguacgaucacagcucaaaaacaaugcaaaggagauuggcaacggaugcuuugaguucuaccacaagugugauaauacaugcauggagaguguuaaaaacggcacuuaugacuacccuaaguauuccgaagaggccaaacugaauagagaagagaucgauggggugaaacuugagagcaccaggauuuaccaaauacuggcuaucuauucuacagucgcgucaaguuuggugcucgucgugagccugggagcaauuuccuuuuggaugugcucuaacgguucguuacagugucggaucugcaucuga

SEQ ID NO: 126140 - RNA, 1701 nt, Artificial Sequence
  derived and/or modified sequence opt3 from hemagglutinin__InfluenzaA__ADD14111
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaucucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 126141 - RNA, 1701 nt, Artificial Sequence; identical to SEQ ID NO: 124685
  derived and/or modified sequence opt3 from hemagglutinin__InfluenzaA__ADD14115

SEQ ID NO: 126142 - RNA, 1701 nt, Artificial Sequence; identical to SEQ ID NO: 124685
  derived and/or modified sequence opt3 from hemagglutinin__InfluenzaA__ADD14117

SEQ ID NO: 126143 - RNA, 1701 nt, Artificial Sequence; identical to SEQ ID NO: 124685
  derived and/or modified sequence opt3 from hemagglutinin__InfluenzaA__ADD14119

SEQ ID NO: 126144 - RNA, 1701 nt, Artificial Sequence; identical to SEQ ID NO: 124685
  derived and/or modified sequence opt3 from hemagglutinin__InfluenzaA__ADD14121

SEQ ID NO: 126145 - RNA, 1701 nt, Artificial Sequence; identical to SEQ ID NO: 124685
  derived and/or modified sequence opt3 from hemagglutinin__InfluenzaA__ADD14123

SEQ ID NO: 126146 - RNA, 1701 nt, Artificial Sequence; identical to SEQ ID NO: 124685
  derived and/or modified sequence opt3 from hemagglutinin__InfluenzaA__ADD14127

SEQ ID NO: 126147 - RNA, 1701 nt, Artificial Sequence
  derived and/or modified sequence opt3 from hemagglutinin__InfluenzaA__ADD14129
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuucucugcaucuugguaaaugcaacauagccggcuggauccuggggaaucccgagugugaaucauugaguacagcaagcuccuggucuuacauuguugagaccucgucaagcgacaacggaacuugcuauccuggcgauuuuaucgacuacgaggagcucagggagcagcugaguuccgugucuagcuucgaacgguuugagauuuucccaaagacauccucauggccgaaucacgauaguaacaagggugucaccgccgcuuguccccaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugaucaggagggaagaaugaauuacuauuggacccugguggaaccaggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguuaaaaaccuguacgagaagguacgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 126148 - RNA, 1701 nt, Artificial Sequence
  derived and/or modified sequence opt3 from hemagglutinin__InfluenzaA__ADD14133
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacguggacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccggguucggaaucauaauuagcgauaccccaguacaugacugcaauacaaccugucaaacgccgaaaggcgcaaucaacacuucgcuccccuuucagaauauucacccuaucacaaucgguaagugcccaaaguaugugaaaucuaccaagcugcgccuugcuacugggcugagaaacguccccuccauucagucaaggggauuguucggcgccauagcgggcuuuaucgaagggggauggacagguaugguggacggcugguacggguaucaucaccagaaugaacaaggaaguggcuacgccgcagaucucaaaagcacccagaacgcuauugacgagaucacgaauaagguuaacuccgugauagagaaaaugaauacccaguucacagccgucgguaaggaguucaaccaccuggaaaagcggauugaaaauuuaaacaaaaagguggaugacggguuucuggauaucuggacuuacaaugcugagcuccuuguacuguuggaaaacgagcgcacccuagacuaucaugauucuaauguuaaaaaccuguacgagaaggugcgaagccagcucaaaaacaaugccaaggaaaucggcaacggauguuucgaguuuuaucacaagugcgacaauacauguauggaaucagucaaaaacggcacuuacgauuauccuaaguacagugaggaagcaaaacugaauagagaggagauugacggggugaaacuugaauccaccaggaucuaucaaauucuggccauauacagcacagucgcuucuucauuggugcucguugugagucugggagcgaucagcuucuggaugugcuccaacgguucuuuacagugccggauuuguaucuga

SEQ ID NO: 126149 - RNA, 1701 nt, Artificial Sequence; identical to SEQ ID NO: 124776
  derived and/or modified sequence opt3 from hemagglutinin__InfluenzaA__ADD14135

SEQ ID NO: 126150 - RNA, 1701 nt, Artificial Sequence; identical to SEQ ID NO: 124685
  derived and/or modified sequence opt3 from hemagglutinin__InfluenzaA__ADD14137

SEQ ID NO: 126151 - RNA, 1701 nt, Artificial Sequence; identical to SEQ ID NO: 125433
  derived and/or modified sequence opt3 from hemagglutinin__InfluenzaA__ADD14139

SEQ ID NO: 126152 - RNA, 1701 nt, Artificial Sequence; identical to SEQ ID NO: 124685
  derived and/or modified sequence opt3 from hemagglutinin__InfluenzaA__ADD14143

SEQ ID NO: 126153 - RNA, 1701 nt, Artificial Sequence; identical to SEQ ID NO: 124685
  derived and/or modified sequence opt3 from hemagglutinin__InfluenzaA__ADD14145

SEQ ID NO: 126154 - RNA, 1701 nt, Artificial Sequence; identical to SEQ ID NO: 124685
  derived and/or modified sequence opt3 from hemagglutinin__InfluenzaA__ADD14147

SEQ ID NO: 126155 - RNA, 1701 nt, Artificial Sequence
  derived and/or modified sequence opt3 from hemagglutinin__InfluenzaA__ADD14151
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucgcgcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucaacagaguuuguaccagaacgccgacgcguacguguucgucgggacuucucgauauuccaagaaauuuaagccugagauugcaauccguccaaaagugagagaucaggagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaccaucagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacgcauugagaauuuaaacaagaaagucgaugacggguuccuggauaucuggacuuacaaugccgaacuccuugugcuguuggagaacgaacgaacccuagacuaucacgauagcaauguaaagaaccuguacgagaaaguuagaucacagcucaagaacaaugcaaaggagaucggcaacggauguuuugaguucuaucauaaaugcgacaauacauguauggaaagugugaagaacggcacuuacgauuauccuaaauacuccgaagaggccaagcugaauagggaagagauugacggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 126156 - RNA, 1701 nt, Artificial Sequence; identical to SEQ ID NO: 124685
  derived and/or modified sequence opt3 from hemagglutinin__InfluenzaA__ADD14153

SEQ ID NO: 126157 - RNA, 1701 nt, Artificial Sequence; identical to SEQ ID NO: 124685
  derived and/or modified sequence opt3 from hemagglutinin__InfluenzaA__ADD14155

SEQ ID NO: 126158 - RNA, 1701 nt, Artificial Sequence; identical to SEQ ID NO: 124685
  derived and/or modified sequence opt3 from hemagglutinin__InfluenzaA__ADD14157

SEQ ID NO: 126159 - RNA, 1701 nt, Artificial Sequence; identical to SEQ ID NO: 124685
  derived and/or modified sequence opt3 from hemagglutinin__InfluenzaA__ADD14162

SEQ ID NO: 126160 - RNA, 1701 nt, Artificial Sequence; identical to SEQ ID NO: 124685
  derived and/or modified sequence opt3 from hemagglutinin__InfluenzaA__ADD14172

SEQ ID NO: 126161 - RNA, 1701 nt, Artificial Sequence; identical to SEQ ID NO: 124685
  derived and/or modified sequence opt3 from hemagglutinin__InfluenzaA__ADD14182

SEQ ID NO: 126162 - RNA, 1701 nt, Artificial Sequence; identical to SEQ ID NO: 124685
  derived and/or modified sequence opt3 from hemagglutinin__InfluenzaA__ADD14192

SEQ ID NO: 126163 - RNA, 1701 nt, Artificial Sequence; identical to SEQ ID NO: 124685
  derived and/or modified sequence opt3 from hemagglutinin__InfluenzaA__ADD14202

SEQ ID NO: 126164 - RNA, 1701 nt, Artificial Sequence
  derived and/or modified sequence opt3 from hemagglutinin__InfluenzaA__ADD21447
augaaggccauccugguguuccuccuuuacaccuuugcuacagcaaacgccgacacucugugcauuggcuaucacgcgaauaacagcacggauaccgucgacacaguuuuggagaaaaaugugacuguaacccauuccgugaacuuacuggaagauagacacaaugggaagcuauguaaacucaggggagucgcuccccugcaucuugguaagugcaacauagccggcuggcuguuggggaauccugagugugaacuccuguucacagcaucuucauggaguuacaucguggagaccagcaacuccgacaauggaacuugcuauccaggcgauuuuauuaacuacgaggagcugcgggagcagcucucuucgguuagcucauucgaacgcuuugagauguucccgaaaaguuccucuuggcccaaucacgaaacaaaccgaggugugaccgccgcuuguccuuaugcaggggccaauagcuuuuaccguaacuuaaucuggcuggucaagaaggaaaauuccuauccaaaacuuucaaagaguuacauuaacaacaaagagaaggaaguguugguacuguggggaauccaucaucccccuacgagcgcugaccaacagucucuauaccagaaugccgaugcguauguuuucgugggcuccucaaaauacaacaagaaguuuagaccagagauagcagccaggcccaaaguccggggccagacugggcgcaugaauuauuacuggacccucguggaaccuggagacacaaucacuuucgaggcuaccgaaaaccugguggucccaagauaugccuuugcaaugaagagggguagcggcagugggauuaucauuucugauacaccgguucacgacugcaauaccacgugucaaacucccaaaggagcuaucaacacaucccuuccuuuccagaauauacacccagugaccauuggcgagugccccaaguacguaaaaagcacuaaccugcggauggccacagguuugcgcaauaucccuucgauucagucucgagggcucuuuggagcgaucgccggcuucaucgagggcggguggaccggaaugauugaugguugguauggcuaccaccaucagaacgaacaaggguccggauacgcagcugacagaaagucaacgcagaaugccauagauggcaucaccaacaaagugaauagugucauugagaagaugaacacacaguucacugcuguggguaaggaauuuaaucaccuggagaaaaggaucgaaaacuuaaacaagaaaguugacgacgggcugcucgauguguggaccuauaaugccgagcuucuggucuugcuagagaacgaacggacacuggacuaccacgauagcaaugugaagaaccucuaugagaaaguacguucccagcugaagaauaacgcaaaggaaauaggcaauggauguuucgaguuuuaccauaaaugcgacgauacuuguauggaaucuguucgcaacggcgccuaugacuacccaaaguauagcgaggaggcuaaacuuaauagagaagagauugauggggugaagcuggaaucaaccaggaucuaccaaaucuuggcgauuuacaguacagucgcauccagccucgugcuguuagucucucugggagccaucucauucuggaugugcaguaacgguagccuacagugccggauuuguauauga

SEQ ID NO: 126165 - RNA, 1701 nt, Artificial Sequence
  derived and/or modified sequence opt3 from hemagglutinin__InfluenzaA__ADD21457
augaaggccauccugguguuccuccuuuacaccuuugcuacagcaaacgccgacacucugugcauuggcuaucacgcgaauaacagcacggauaccgucgacacaguuuuggagaaaaaugugacuguaacccauuccgugaacuuacuggaagauagacacaaugggaagcuauguaaacucaggggagucgcuccccugcaucuugguaagugcaacauagccggcuggcuguuggggaauccugagugugaacuccuguucacagcaucuucauggaguuacaucguggagaccagcaacuccgacaauggaacuugcuauccaggcgauuuuauuaacuacgaggagcugcgggagcagcucucuucgguuagcucauucgaacgcuuugagauguucccgaaaaguuccucuuggcccaaucacgaaacaaaccgaggugugaccgccgcuuguccuuaugcaggggccaauagcuuuuaccguaacuuaaucuggcuggucaagaaggaaaauuccuauccaaaacuuucaaagaguuacauuaacaacaaagagaaggaaguguugguacuguggggaauccaucaucccccuacgagcgcugaccaacagucucuauaccagaaugccgaugcguauguuuucgugggcuccucaaaauacaacaagaaguuuagaccagagauagcagccaggcccaaaguccggggccagacugggcgcaugaauuauuacuggacccucguggaaccuggagacacaaucacuuucgaggcuaccgguaaccugguggucccaagauaugccuuugcaaugaagaggggcagcgggaguggaauuaucauuucugauacaccgguucacgacugcaauaccacgugucaaacucccaaaggcgcugugaacacaucccuuccuuuccagaauauccacccaguaaccauaggugaaugccccaaguacgugaaaagcacuaaccugcggauggccacaggguugcgcaauauuccuucgauccagucucgaggacucuuuggcgcgauugccggcuucaucgaagggggauggaccgguaugaucgauggcugguauggguaccaccaucagaacgagcaaggauccggcuacgcagcugacagaaagucaacgcagaaugccauugaugguauaaccaacaaagucaauagugugaucgaaaagaugaacacacaguucacugcuguugggaaggaguuuaaucaccuggagaaaaggauugagaacuuaaacaagaaaguggacgacggccugcucgaugucuggaccuauaaugccgaacuucugguguugcuagagaacgagcggacacuggacuaccacgauagcaauguaaagaaccucuaugaaaaaguucguucccagcugaagaauaacgcaaaggagaucggaaauggcuguuucgaauuuuaccauaaaugcgacgauacuuguauggagucugugcgcaacgggaccuaugacuacccaaaguauagcgaagaggccaaacuuaauagagaggaaauagauggagucaagcuggagucaacaaggauuuaccaaaucuuggcuaucuacaguaccguggcguccagccucguccuguuagugucucugggugcaauuucauucuggaugugcaguaacggcagccuacagugccggaucuguauuuga

SEQ ID NO: 126166 - RNA, 1698 nt, Artificial Sequence
  derived and/or modified sequence opt3 from hemagglutinin__InfluenzaA__ADD21467
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagcaagucuuacgccaacaauaaagaaaaggaggugcuaguacucuggggcguucaucacccuccaaacauccgcgaucagcgagcucuguaccacacugaaaacgcauauguguccgucgugucaagccauuacagucguagauucacccccgagauagccaaaaggccuaaggugcgggggcaggaaggacgcaucaauuauuacuggacacuucuggagccaggugacacuauuaucuuugaggcuaacggcaauuugauugccccgugguaugcguucgcacucucuagaggguuuggauccggcaucauaaccagcaacgcccccauggaugaaugugacgcuaagugccagacaccucaaggugccauuaauucgucucugccauuccagaacguccaccccguuaccaucggggaguguccuaaauacgcaagguccgcuaaguuacggauggugacgggacugcgcaauauuccaucaauccagagucgaggccucuuuggcgccaucgcgggguucauugaaggagguuggacuggcaugguagaugggugguauggauaccaucaccagaacgagcaaggcagcgguuacgccgcagaccagaaauccacacagaaugcuauaaacgggaucaccaauaaggugaacucugucauugaaaagaugaauacucaguuuacagccgugggcaaagaguucaacaaacuugagagaaggauggaaaaucugaacaagaagguugaugacggauucuuggauaucuggaccuauaacgcugagcuacuggugcuccuggaaaaugagcggacgcuugacuuucacgacagcaacgucaaaaaucuguacgaaaaggugaaaucacaauugaagaacaaugccaaagagauaggcaacgggugcuucgaguuuuaucauaaguguaauaacgaaugcauggagaguguaaagaauggaaccuacgauuaucccaaauacuccgaagagagcaagcucaaccgugagaaaauugacgguguuaagcuggaaucuaugggcguguaucagaucuuagcaaucuacucaacagucgccaguagccuggugcuacucgucucccugggggcuauuucuuucuggaugugcucgaauggaagccuucagugucgcaucugcauuuga

SEQ ID NO: 126167 - RNA, 1701 nt, Artificial Sequence
  derived and/or modified sequence opt3 from hemagglutinin__InfluenzaA__ADD21560
augaagaccaucauugccuucagccacauacugugccucaucuacgcucagaaacuucccggcuccgacaacucuauggcaacacuguguuuggggcaucacgccgugccuaauggaacuuuagucaagacgauuaccgaugaccaaaucgagguuacaaacgcgacugaacuggugcagucaaguagcaccgguagaauuugcaauuccccacaucacauccuagauggcaaaaacuguacacucauagacgcucugcuuggggauccgcauugcgacgauuuucagaauaaggagugggaccuguucguagaaaggucuaccgccuauucgaacuguuaccccuauuacgugccugauuaugcaucauugcggagccucgucgccaguuccggaacucuggaguuuacacaggaaucuuucaauuggaccggcgugacgcaagacgguagcuccuacacuugccgccgaaaaucaguuaacaguuucuucagccgucugaauuggcuccacaacuuagauuauaaguacccagcucugaaugugaccaugcccaacaaugacaaguuugauaaacuuuacaucuggggaguccaccauccugggacagacagagaccagacuaacuuguaugugcaggcaucuggcaggguaaccguuuccacaaagcggucacagcaaaccgugauuccaaauaucggcagccgccccugggucagaggggugaguucuauuaucuccauauacuggacgauugugaaaccuggagauauccugcuaauuaacagcacugguaaccucaucgccccaaggggcuauuucaagauccagucggggaaaucuuccauuaugcggucagacgcuccgauaggaaauuguaacagugagugcaucacacccaauggcagcauuccuaacgauaagccauuucagaaugucaaccgcaucaccuacggugccuguccccgauauguuaagcagaauacucugaaacuugcgacagggaugagaaacgugccugagaagcaaaccaggggaauauucggcgcaauugccggcuuuaucgaaaaugggugggagggaaugguagacgguugguacggcuuccggcaccagaacuccgaagggacgggacaggcugccgaucugaaaucuacccaagcagcuaucaaucagauuacaggcaaguugaaccgugugaucaaaaagacuaaugagaaauuucaucagauugagaaggaauuuagcgaggucgaaggucgcauacaggaccucgagaaguauguggaagauaccaaaaucgaccuguggucauacaacgccgaguuacugguugcgcucgagaaucaacacacaauugaucuuacugacagugaaaugaacaagcuguucgagagaaccaggaaacaguugcgggaaaacgccgaggauauggggaauggcugcuuuaagaucuaccacaaaugugacaacgcaugcaucggauccauucgaaauggcacauaugaccaugauguguaccgcgacgaagcucuaaacaauagauuccagauaaagagcguccagcugaagucuggguauaaagauuggauccucuggauuucauuugccaugaguugcuuccugcuuugugugguacuguugggauuuaucauguggaccugccaaaaggguaacauuaaauguaauaucugcauauga

SEQ ID NO: 126168 - RNA, 1701 nt, Artificial Sequence; identical to SEQ ID NO: 124672
  derived and/or modified sequence opt3 from hemagglutinin__InfluenzaA__ADD21734

SEQ ID NO: 126169 - RNA, 1701 nt, Artificial Sequence; identical to SEQ ID NO: 124685
  derived and/or modified sequence opt3 from hemagglutinin__InfluenzaA__ADD21744

SEQ ID NO: 126170 - RNA, 1701 nt, Artificial Sequence
  derived and/or modified sequence opt3 from hemagglutinin__InfluenzaA__ADD21764
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagagagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggagagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 126171 - RNA, 1701 nt, Artificial Sequence
  derived and/or modified sequence opt3 from hemagglutinin__InfluenzaA__ADD21774
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguguccagagcaggggauuguuuggcgcgauugccggcuucauagaagggggauggacugguaugguggacggcugguacggguaucaucaccagaaugaacaaggauccggcuacgcagcugaucucaaaucuacacagaacgccaucgacgagauuaccaauaagguuaacagcgugaucgagaaaaugaauacgcaguuuaccgcugucgguaaggaguucaaccaccuggaaaagcggauagaaaauuuaaacaaaaagguggaugacggguuccuggauauuuggacauacaaugccgagcuccuuguacuguuggaaaacgagcgcacucuagacuaucaugauucaaauguuaaaaaccuguacgagaaggugcgaagucagcucaaaaacaaugcaaaggaaaucggcaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacuaggauuuaucaaauccuggcuauuuacucaaccgucgcgaguagcuuggugcucguugugucccugggagcaauaucuuuuuggaugugcucgaacgguagcuuacagugccggaucuguauuuga

SEQ ID NO: 126172 - RNA, 1701 nt, Artificial Sequence; identical to SEQ ID NO: 124685
  derived and/or modified sequence opt3 from hemagglutinin__InfluenzaA__ADD21784

SEQ ID NO: 126173 - RNA, 1701 nt, Artificial Sequence; identical to SEQ ID NO: 125845
  derived and/or modified sequence opt3 from hemagglutinin__InfluenzaA__ADD21794

SEQ ID NO: 126174 - RNA, 1701 nt, Artificial Sequence; identical to SEQ ID NO: 124685
  derived and/or modified sequence opt3 from hemagglutinin__InfluenzaA__ADD21804

SEQ ID NO: 126175 - RNA, 1701 nt, Artificial Sequence
  derived and/or modified sequence opt3 from hemagglutinin__InfluenzaA__ADD21814
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccucuuggauccugggcaauccugagugugaaucauugaguacagcaagcuccuggucuuacauuguugagaccucgucaagcgacaacgggacuugcuauccaggagauuuuaucgacuacgaagaacucagggagcagcugaguuccgugucuagcuucgaacgguuugagauuuucccgaagacauccucauggcccaaucacgauaguaacaagggcgucaccgccgcuuguccucaugcaggagccaagagcuuuuauaagaaucugaucuggcucgugaaaaaggggaacucuuacccaaaauuauccaagucauauauaaaugacaagggaaaagaaguacugguucuuuggggcauccaccaccccagcacgagugcugaucaacagucuuuguaccagaacgccgacgcguacguguucgucggcacuucccgcuauagcaagaaauuuaagccugagauugcaauccgaccaaaagugcgugaucaggaggggagaaugaauuacuauuggacccugguggaacccggagacaagauuacauucgaggccacugguaaccuagucguuccuagguacgcuuuugccauggaacggaacgcaggcucggggaucauaauuucugauaccccagugcaugacugcaauacaaccugucaaacgccgaaaggagcuaucaacacuucccuccccuuccagaauauucacccuaucacaaucggcaagugcccaaaguauguaaaaucaaccaagcugcgccuugccacuggucugagaaacgugcccaguauucagagcaggggguuguuuggagcgauagccggcuucaucgagggcggguggacaggaauggucgacgguugguacggcuaucaucaccagaaugaacaaggguccggauacgcagcugaucucaaaucuacccagaacgccauugacgagaucacgaauaaggugaacagcguuauagagaaaaugaauacccaguuuacagcugugggcaaggaguucaaccaccuggagaagcggauugaaaauuuaaacaaaaaggucgaugacgguuuccuggauaucuggacuuacaaugccgagcuccuugugcuguuggaaaacgagcgcacccuagacuaucaugauucaaauguuaaaaaccuguacgagaagguacgaagucagcucaaaaacaaugcaaaggaaaucgggaacggcuguuuugaguucuaucacaagugcgacaauacauguauggaauccgugaaaaacggaacuuacgauuauccuaaguacagcgaggaagccaaacugaauagagaggagauugacggcgucaaacuugaaucuaccaggaucuaucaaauucuggcuauauacucaacaguggcgaguagcuugguccucgugguuucccugggggcaaucucuuuuuggaugugcucgaacgguagcuuacagugccggauuuguaucuga

SEQ ID NO: 126176 - RNA, 1701 nt, Artificial Sequence; identical to SEQ ID NO: 125845
  derived and/or modified sequence opt3 from hemagglutinin__InfluenzaA__ADD21824

SEQ ID NO: 126177 - RNA, 1701 nt, Artificial Sequence; identical to SEQ ID NO: 125845
  derived and/or modified sequence opt3 from hemagglutinin__InfluenzaA__ADD21834

SEQ ID NO: 126178 - RNA, 1701 nt, Artificial Sequence; identical to SEQ ID NO: 125849
  derived and/or modified sequence opt3 from hemagglutinin__InfluenzaA__ADD21844

SEQ ID NO: 126179 - RNA, 1701 nt, Artificial Sequence; identical to SEQ ID NO: 125849
  derived and/or modified sequence opt3 from hemagglutinin__InfluenzaA__ADD21854

SEQ ID NO: 126180 - RNA, 1701 nt, Artificial Sequence; identical to SEQ ID NO: 125787
  derived and/or modified sequence opt3 from hemagglutinin__InfluenzaA__ADD21864

SEQ ID NO: 126181 - RNA, 1701 nt, Artificial Sequence
  derived and/or modified sequence opt3 from hemagglutinin__InfluenzaA__ADD21884
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggggagugugaaaaacggaacuuacgacuauccuaaguacuccgaagaggccaaacugaauagagaagagauugauggugucaaacuugagagcaccaggaucuaucaaauucuggcuauauacucuacaguggcgucaaguuugguccucgugguuagccugggcgcaaucuccuuuuggaugugcucuaacgggucguuacagugccggauuuguaucuga

SEQ ID NO: 126182 - RNA, 1701 nt, Artificial Sequence; identical to SEQ ID NO: 125787
  derived and/or modified sequence opt3 from hemagglutinin__InfluenzaA__ADD21894

SEQ ID NO: 126183 - RNA, 1701 nt, Artificial Sequence
  derived and/or modified sequence opt3 from hemagglutinin__InfluenzaA__ADD22501
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaaaucgaugacggguuccuggauaucuggacuuacaaugccgagcuccuuguccuguuggaaaacgagcggacccuagacuaucaugauagcaaugugaagaaccuguacgagaaaguacgcauucagcucaagaacaaugcaaaggaaaucggcaacggauguuucgaguucuaucacaaaugcgacaauacauguauggaaucaguuaagaacggcacuuacgauuauccuaaauacagugaggaagccaagcugaaucgagaggagauugacggggugaaacuugaauccaccagaauauaucaaauccuggcuauuuacagcacagucgcgucuucauuggugcucgucgugagucugggagcaaucagcuuuuggaugugcuccaacgguucuuuacagugcaggaucuguauuuga

SEQ ID NO: 126184 - RNA, 1701 nt, Artificial Sequence; identical to SEQ ID NO: 125787
  derived and/or modified sequence opt3 from hemagglutinin__InfluenzaA__ADD22511

SEQ ID NO: 126185 - RNA, 1701 nt, Artificial Sequence
  derived and/or modified sequence opt3 from hemagglutinin__InfluenzaA__ADD22521
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaagaucgaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 126186 - RNA, 1701 nt, Artificial Sequence; identical to SEQ ID NO: 124685
  derived and/or modified sequence opt3 from hemagglutinin__InfluenzaA__ADD22531

SEQ ID NO: 126187 - RNA, 1701 nt, Artificial Sequence
  derived and/or modified sequence opt3 from hemagglutinin__InfluenzaA__ADD22541
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucuaaguauuccaaaaaguuuaaaccugagauugcaauccgcccaaaggugcgagaccaggagggucguaugaauuacuauuggacccugguggaacccggcgauaaaauuacauucgaggccacugggaaccuagucguuccuagauacgcuuuugccauggaaaggaacgcaggaagcggcaucauaauuucggacaccccagugcaugauugcaauacaaccugucaaacgccgaagggugcuaucaacacuucucuccccuuccagaauauucacccuaucacaaucgggaagugcccaaaauauguaaaguccaccaaacugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaccucaaguccacccagaacgccauugaugagaucacgaauaaagugaacucuguuauagagaagaugaauacccaguuuacagcuguggggaaggaguucaaccaccuggagaaaaggauugaaaauuuaaacaagaaagucgacgauggcuuccuggacaucuggacuuacaaugccgagcuccuugugcuguuggaaaacgagcggacccuagauuaucaugacagcaauguaaagaaccuguacgagaaaguucgcucacagcucaagaacaaugcaaaggaaaucggaaacggcuguuuugaguucuaucacaaaugcgauaauacauguauggaaagugugaagaacgggacuuacgacuauccuaaauacuccgaggaagccaagcugaaucgagaggagauugauggagucaaacuugaaagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 126188 - RNA, 1701 nt, Artificial Sequence; identical to SEQ ID NO: 125787
  derived and/or modified sequence opt3 from hemagglutinin__InfluenzaA__ADD22554

SEQ ID NO: 126189 - RNA, 1701 nt, Artificial Sequence; identical to SEQ ID NO: 125787
  derived and/or modified sequence opt3 from hemagglutinin__InfluenzaA__ADD22564

SEQ ID NO: 126190 - RNA, 1701 nt, Artificial Sequence
  derived and/or modified sequence opt3 from hemagglutinin__InfluenzaA__ADD22574
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacucucaaaggcgcaaucaacacaucucugccguuccagaauauucaccccaucaccaucgguaagugcccuaaguauguaaaauccacuaaacuucgccuggcuacaggguugagaaacgugccaucaauucagaguaggggacucuuuggcgccauagcgggcuucaucgaagggggauggaccgguauggucgacggcugguacggguaucaucaccagaaugaacaaggaagcggcuacgccgcagaucugaaguccacgcagaacgcuauugacgagaucaccaauaaggugaacucuguuauagagaaaaugaauacacaguuuacugccguggguaaggaguucaaccacuuagaaaagcggauugaaaaucugaacaaaaagaucgaugacggguuccucgauaucuggaccuacaaugcugagcuucuggucuugcuagaaaacgagcgcacacuggacuaucaugauagcaaugugaaaaaccucuacgagaagguacgaucacagcugaaaaacaaugccaaggaaauuggcaacggauguuuugaguucuaucacaagugcgacaauacuuguauggaaaguguuaaaaacggcaccuacgauuaucccaaguacuccgaggaagcaaaacuuaauagagaggagaucgacggggugaagcuggaaagcacaaggauuuaucaaauauuggccaucuacucuaccgucgcuucaagucucgugcuggucgugagcuuaggagcgauuuccuuuuggaugugcucuaacgguucgcugcagugccggaucuguaucuga

SEQ ID NO: 126191 - RNA, 1701 nt, Artificial Sequence; identical to SEQ ID NO: 125787
  derived and/or modified sequence opt3 from hemagglutinin__InfluenzaA__ADD22584

SEQ ID NO: 126192 - RNA, 1701 nt, Artificial Sequence; identical to SEQ ID NO: 124685
  derived and/or modified sequence opt3 from hemagglutinin__InfluenzaA__ADD22594

SEQ ID NO: 126193 - RNA, 1701 nt, Artificial Sequence; identical to SEQ ID NO: 125787
  derived and/or modified sequence opt3 from hemagglutinin__InfluenzaA__ADD22604

SEQ ID NO: 126194 - RNA, 1701 nt, Artificial Sequence; identical to SEQ ID NO: 125787
  derived and/or modified sequence opt3 from hemagglutinin__InfluenzaA__ADD22614

SEQ ID NO: 126195 - RNA, 1701 nt, Artificial Sequence; identical to SEQ ID NO: 125787
  derived and/or modified sequence opt3 from hemagglutinin__InfluenzaA__ADD22624

SEQ ID NO: 126196 - RNA, 1701 nt, Artificial Sequence
  derived and/or modified sequence opt3 from hemagglutinin__InfluenzaA__ADD22634
augaaggccauccuggugguccuccuuugcaccuucgcuacagcaaacgccgacacucuguguauuggcuaccacgcgaauaacagcacggauaccguugacacaguguuggagaagaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaggagcucagggagcagcugagcaguguguccucuuucgaacgguuugagauuuucccgaagacaagcuccuggcccaaucacgauucaaacaagggugucaccgccgcuugcccucaugcaggggccaaaaguuuuuacaagaaucugaucuggcucgugaaaaagggaaacagcuauccaaaauuaucuaaguccuacauaaaugacaagggcaaagaaguacugguucuuuggggcauccaccaccccucaacgagcgcugaucaacagaguuuguaucagaacgccgacgcguacguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcaugacuguaauacaaccugccaaacgccgaaaggcgcuaucaacacuucucuccccuuccagaauauucacccuaucacaaucgguaaguguccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaucaccagaaugaacaaggaagcggcuaugcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaagaucgaugacggguuccuggauaucuggacuuacaaugccgagcuccuuguccuguuggaaaacgagcgcacccuagacuaccaugauagcaaugugaaaaaccuguaugagaagguacgaucacagcucaaaaacaaugcaaaggaaauuggcaacggaugcuuugaguucuaccacaagugugacaauacaugcauggaaaguguuaaaaacggcacuuaugauuacccuaaguauuccgaggaagccaaacugaauagagaggagaucgacggggugaaacuugaaagcaccaggauuuaccaaauacuggcuaucuauucuacagucgcgucaaguuuggugcucgucgugagccugggagcaauuuccuuuuggaugugcucuaacgguucguuacagugucggaucugcaucuga

SEQ ID NO: 126197 - RNA, 1701 nt, Artificial Sequence
  derived and/or modified sequence opt3 from hemagglutinin__InfluenzaA__ADD22645
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugaaggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 126198 - RNA, 1701 nt, Artificial Sequence
  derived and/or modified sequence opt3 from hemagglutinin__InfluenzaA__ADD22665
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaggagcucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagcgcaaagaaguacugguucuuuggggcauccaccaccccucaacgagcgcugaccaacagaguuuguaccagaacgccgaugcguacguguucgucgggacuucuaaguauuccaaaaaguuuaaaccugagauugcaauccgaccaaaggugcgugaccaggagggaagaaugaauuacuauuggacccugguggaacccggugauaaaauuacauucgaggccacuggcaaccuagucguuccuagguacgcuuuugccauggaacggaacgcagggagcggaaucauaauuucggacaccccagugcaugauugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaccucaaguccacccagaacgccauugaugagaucacgaauaaagugaacucuguuauagagaagaugaauacccaguuuacagcuguggguaaggaguucaaccaccuggaaaaacggauugaaaauuuaaacaagaaagucgacgauggguuccuggacaucuggacuuacaaugccgagcuccuugugcuguuggaaaacgagcgcacccuagauuaucaugacagcaauguaaagaaccuguacgagaaaguucgaucacagcucaagaacaaugcaaaggaaaucggcaacggauguuuugaguucuaucacaaaugcgauaauacauguauggaaagugugaagaacggcacuuacgacuauccuaaauacuccgaggaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126199 - RNA, 1701 nt, Artificial Sequence; identical to SEQ ID NO: 125787
  derived and/or modified sequence opt3 from hemagglutinin__InfluenzaA__ADD22675

SEQ ID NO: 126200 - RNA, 1701 nt, Artificial Sequence; identical to SEQ ID NO: 125787
  derived and/or modified sequence opt3 from hemagglutinin__InfluenzaA__ADD22685

SEQ ID NO: 126201 - RNA, 1701 nt, Artificial Sequence; identical to SEQ ID NO: 125787
  derived and/or modified sequence opt3 from hemagglutinin__InfluenzaA__ADD22695

SEQ ID NO: 126202 - RNA, 1701 nt, Artificial Sequence
  derived and/or modified sequence opt3 from hemagglutinin__InfluenzaA__ADD22722
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauagacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucaggaaacggcacuugcuauccaggugacuuuaucgauuacgaagaacuccgggagcagcugagcaguguguccucuuucgaacgcuuugagauuuucccgaaaacaagcuccuggcccaaucacgacucaaacaagggggucaccgccgcuuguccucaugcaggagccaagaguuuuuauaaaaaucugaucuggcucgugaagaaaggcaacagcuacccaaaguuaucuaaauccuauauaaaugauaagggcaaggaaguacugguucuuugggggauccaccaccccucaacgagcgcugaccaacagaguuuguaccagaacgccgaugcguacguguucgucggaacuucuuccuauagcaaaaaguuuaaaccugagauugcaauccgaccaaaggugcgugaccaggaggguagaaugaauuacuauuggacccugguggaacccggcgauaaaauuacauucgaggccacugggaaccuagucguuccuagguacgcuuuugccauggaacggaacgcaggaucgggcaucauaauuucugacaccccagugcaugauugcaauacaaccugucaaacgccgaagggugcuaucaacacuucccuccccuuccagaauauucacccuaucacaaucgggaaaugcccaaaguauguaaagucaaccaaacugcgccuugccacuggacugagaaacgugcccaguauucagagcaggggcuuguuuggcgcgauagccggguucaucgagggagguuggacaggcauggucgacgggugguacggauaucaucaccagaaugaacaaggcuccgguuacgcagcugaccucaagucuacccagaacgccauugaugagaucacgaauaaagugaacagcguuauagagaagaugaauacccaguuuacagcuguggggaaagaguucaaccaccuggagaagcggauugaaaauuuaaacaagaaagucgacgauggcuuccuggacaucuggacuuacaaugccgagcuccuugugcuguuggaaaacgagcgcacccuagauuaucaugacucaaauguaaagaaccuguacgagaaaguucgaagucagcucaagaacaaugcaaaagaaaucggaaacggcuguuuugaguucuaucacaagugcgauaauacauguauggaauccgugaagaacgggacuuacgacuauccuaaauacagcgaggaagccaagcugaauagagaggagauugauggagucaaacuugaaucuaccaggaucuaucaaauucuggcuauauacucaacaguggcgaguagcuugguccucgugguuucccugggugcaaucucuuuuuggaugugcucgaacggcagcuuacagugccggauuuguaucuga

SEQ ID NO: 126203 - RNA, 1701 nt, Artificial Sequence; identical to SEQ ID NO: 126185
  derived and/or modified sequence opt3 from hemagglutinin__InfluenzaA__ADD22732

SEQ ID NO: 126204 - RNA, 1701 nt, Artificial Sequence
  derived and/or modified sequence opt3 from hemagglutinin__InfluenzaA__ADD22742
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucuuccuauagcaagaaauuuaagccugagauugcaauccgcccaaaagugcgagaccaggagggucguaugaauuacuauuggacccugguggaacccggcgauaagauuacauucgaggccacugggaaccuagucguuccuagauacgcuuuugccauggaaaggaacgcaggaucgggcaucauaauuucugacaccccagugcaugauugcaauacaaccugucaaacgccgaaaggugcuaucaacacuucccuccccuuccagaauauucacccuaucacaaucgggaagugcccaaaguauguaaaaucaaccaagcugcggcuugccacuggacugcgcaacgugcccaguauucagagcagaggcuuguuuggcgcgauagccggguucaucgagggagguuggacaggcauggucgacgggugguacggauaucaucaccagaaugaacaaggcuccgguuacgcagcugaccucaaaucuacccagaacgccauugaugagaucacgaauaaggugaacagcguuauagagaaaaugaauacccaguuuacagcuguggggaaggaguucaaccaccuggagaagaggauugaaaauuuaaacaaaaaggucgacgauggcuuccuggacaucuggacuuacaaugccgagcuccuugugcuguuggaaaacgagcggacccuagauuaucaugacucaaauguaaagaaccuguacgagaagguucgcagucagcucaaaaacaaugcaaaggaaaucggaaacggcuguuuugaguucuaucacaagugcgauaauacauguauggaauccgugaaaaacgggacuuacgacuauccuaaguacagcgaggaagccaaacugaaucgagaggagauugauggagucaaacuugaaucuaccagaaucuaucaaauucuggcuauauacucaacaguggcgaguagcuugguccucgugguuucccugggugcaaucucuuuuuggaugugcucgaacggcagcuuacagugcaggauuuguaucuga

SEQ ID NO: 126205 - RNA, 1701 nt, Artificial Sequence; identical to SEQ ID NO: 124685
  derived and/or modified sequence opt3 from hemagglutinin__InfluenzaA__ADD22752

SEQ ID NO: 126206 - RNA, 1701 nt, Artificial Sequence; identical to SEQ ID NO: 124776
  derived and/or modified sequence opt3 from hemagglutinin__InfluenzaA__ADD22762

SEQ ID NO: 126207 - RNA, 1701 nt, Artificial Sequence; identical to SEQ ID NO: 125787
  derived and/or modified sequence opt3 from hemagglutinin__InfluenzaA__ADD22772

SEQ ID NO: 126208 - RNA, 1701 nt, Artificial Sequence; identical to SEQ ID NO: 125787
  derived and/or modified sequence opt3 from hemagglutinin__InfluenzaA__ADD22782

SEQ ID NO: 126209 - RNA, 1701 nt, Artificial Sequence
  derived and/or modified sequence opt3 from hemagglutinin__InfluenzaA__ADD22792
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucaauuacgaagaacucagggagcagcugagcaguguguccucuuucgaacgguuugagauuuucccgaagacaagcuccuggcccaaccacgauucaaauaagggggucaccgccgcuuguccucaugcaggagccaaaaguuuuuauaagaaccugaucuggcucgugaaaaagggcaauagcuacccaaaauuaucuaaguccuauauaaacgacaagggcaaagaaguacugguucuuugggggauccaccaccccucaacgagcgcugaucaacagaguuuguaccagaaugccgacgcguacguguucgucggaacuucucgcuauuccaagaaauuuaagccugagauugcaauccgaccaaaagugcgugaucaggaggguagaaugaacuacuauuggacccugguggaacccggcgacaagauuacauucgaggccacugggaaccuagucguuccuagguacgcuuuugccauggaacggaaugcaggaagcggcaucauaauuucggauaccccagugcaugacugcaacacaaccugucaaacgccgaaaggugcuaucaauacuucucuccccuuccagaacauucacccuaucacaaucgggaagugcccaaaguauguaaaauccaccaagcugcgccuugccacuggacugagaaaugugcccucaauucagaguaggggcuuguuuggcgcgauagccggguucaucgagggagguuggacaggcauggucgaugggugguacggauaucaucaccagaacgaacaaggcagcgguuacgcagcugaccucaaauccacccagaaugccauugacgagaucacgaacaagguaaauucuguuauagagaaaaugaacacccaguuuacagcuguggggaaggaguucaaucaccuggagaagcggauugaaaacuuaaauaaaaaggucgaugacggcuuccuggauaucuggacuuacaacgccgagcuccuugugcuguuggaaaaugagcgcacccuagacuaucaugauagcaacgugaaaaaccuguacgagaagguucgaucacagcucaaaaauaacgcaaaggaaaucggaaauggcuguuuugaguucuaucacaagugcgacaacacauguauggaaagugugaaaaaugggacuuacgauuauccuaaguacuccgaggaagccaaacugaacagagaggagauugacggagucaaacuugaaagcaccaggaucuaucaaauucuggcuauauacucuacaguggcgucaaguuugguccucgugguuagccugggugcaaucuccuuuuggaugugcucuaauggcucguuacagugccggauuuguaucuga

SEQ ID NO: 126210 - RNA, 1701 nt, Artificial Sequence; identical to SEQ ID NO: 126185
  derived and/or modified sequence opt3 from hemagglutinin__InfluenzaA__ADD22802

SEQ ID NO: 126211 - RNA, 1701 nt, Artificial Sequence; identical to SEQ ID NO: 125787
  derived and/or modified sequence opt3 from hemagglutinin__InfluenzaA__ADD22812

SEQ ID NO: 126212 - RNA, 1701 nt, Artificial Sequence
  derived and/or modified sequence opt3 from hemagglutinin__InfluenzaA__ADD22822
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucggccgacaacggaacuugcuauccaggcgauuuuaucgacuacgaggagcucagggagcagcugucaagcgugaguuccuucgaacgguuugagauuuucccgaagacaucuagcuggcccaaucacgauuccaacaagggugucaccgcugcauguccucaugccggggcuaaaucauuuuauaagaaucugaucuggcucgugaaaaagggaaacaguuacccaaaauuaagcaagucuuauauaaaugacaagggcaaagaaguacugguucuuuggggcauccaccaccccuccacgucagccgaucaacagagcuuguaccagaacgcggacgcauacguguucgucgggaccaguaaguauucuaaaaaguuuaaaccugagauugccauccgcccaaaggugcgagaucaggagggacguaugaauuacuauuggacucugguggaacccggugacaaaauuacauucgaggcuacuggcaaccuagucguuccuagauacgccuuugcaauggaaaggaacgcuggguccggaaucauaauuagcgauaccccagugcaugacugcaauacaaccugucaaacgccgaagggcgccaucaacacuucgcuccccuuccagaauauucacccuaucacaaucgguaagugcccaaaauauguaaagucuaccaaacugcggcuugcgacugggcugcgcaacgugcccuccauucagucaagaggauuguuuggcgccauagcaggcuucaucgaagggggauggacagguauggucgacggcugguacggguaucaucaccagaaugaacaaggaaguggcuacgcugccgaucucaagagcacccagaacgcuauugacgagaucacgaauaaagugaacuccguuauagagaagaugaauacccaguuuacagccguggguaaggaauuuaaccaccuggagaaaaggauugaaaauuuaaacaagaaaaucgaugacggguuccuggauaucuggacuuacaaugcagagcuccuuguccuguuggaaaacgagcggacccuagacuaucaugauucuaaugugaagaaccuguacgagaaaguacgcagccagcucaagaacaaugccaaggaaauuggcaacggauguuucgaguucuaucacaaaugcgacaauauguguauggaaucaguuaagaacggcacauacgauuauccuaaauacagugaggaagcuaagcugaaucgagaggagaucgacggggugaaacuugaauccacuagaauuuaucaaauacuggcgaucuacagcaccgucgcaucuucauuggugcucgucgugagucugggagccauuagcuuuuggaugugcuccaacgguucuuuacagugcaggaucuguaucuga

SEQ ID NO: 126213 - RNA, 1701 nt, Artificial Sequence; identical to SEQ ID NO: 125787
  derived and/or modified sequence opt3 from hemagglutinin__InfluenzaA__ADD22832

SEQ ID NO: 126214 - RNA, 1701 nt, Artificial Sequence; identical to SEQ ID NO: 125787
  derived and/or modified sequence opt3 from hemagglutinin__InfluenzaA__ADD22842

SEQ ID NO: 126215 - RNA, 1701 nt, Artificial Sequence
  derived and/or modified sequence opt3 from hemagglutinin__InfluenzaA__ADD22852
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucgugauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 126216 - RNA, 1701 nt, Artificial Sequence
  derived and/or modified sequence opt3 from hemagglutinin__InfluenzaA__ADD22941
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaauuaguuggagcuacaucguugagaccuccucuucgggaaacggcacuugcuauccaggugacuuuauugauuacgaagaacucagggagcagcugucaagcgugaguuccuucgaacgguuugagaucuucccgaagacaucuagcuggcccaaucacgacuccaacaagggggucaccgccgcuuguccucaugcaggagccaaaucauuuuauaagaaucugauauggcucgugaaaaagggcaacaguuacccaaaauuaagcaagucuuauaucaaugauaagggcaaagaaguacugguucuuugggggauucaccaccccuccacgucagcugaccaacagagcuuguaccagaacgccgaugcguacguguucgucggaaccagucgcuauucuaagaaauuuaagccugagaucgcaauucgaccaaaagugcgugaccaggaggguagaaugaauuacuauuggacucugguggaacccggcgauaagaucacauucgaggccacugggaaccuagucguuccuagguacgcuuuugccauggaacggaacgcaggauccggcauaauuaucagcgacaccccagugcaugauugcaauacaaccugucaaacgccgaaaggugcuauuaacacuucgcuccccuuccagaauauccacccuaucacaauugggaagugcccaaaguauguaaaaucuaccaagcugcgccuugccacuggacugagaaacgugcccuccauacagucaaggggcuuguuuggcgcgaucgccggguucauugagggagguuggacaggcauggucgacgggugguacggauaucaucaccagaaugaacaaggcagugguuacgcagcugaccucaaaagcacccagaacgccaucgaugagauaacgaauaaggugaacuccguuauugagaaaaugaauacccaguuuacagcuguggggaaggaguucaaccaccuggagaagcggaucgaaaauuuaaacaaaaaggucgacgauggcuuccuggacaucuggacuuacaaugccgagcuccuugugcuguuggaaaacgagcgcacccuagauuaucaugacucuaauguaaagaaccuguacgagaagguucgaagccagcucaaaaacaaugcaaaggaaauuggaaacggcuguuuugaguucuaucacaagugcgauaauacauguauggaaucagugaaaaacgggacuuacgacuauccuaaguacagugaggaagccaaacugaauagagaggagaucgauggagucaaacuugaauccaccaggauuuaucaaauacuggcuaucuacagcacaguggcgucuucauugguccucgugguuagucugggugcaauuagcuuuuggaugugcuccaacggcucuuuacagugccggaucuguaucuga

SEQ ID NO: 126217 - RNA, 1701 nt, Artificial Sequence; identical to SEQ ID NO: 125787
  derived and/or modified sequence opt3 from hemagglutinin__InfluenzaA__ADD22951

SEQ ID NO: 126218 - RNA, 1701 nt, Artificial Sequence; identical to SEQ ID NO: 125787
  derived and/or modified sequence opt3 from hemagglutinin__InfluenzaA__ADD22961

SEQ ID NO: 126219 - RNA, 1701 nt, Artificial Sequence; identical to SEQ ID NO: 125787
  derived and/or modified sequence opt3 from hemagglutinin__InfluenzaA__ADD22971

SEQ ID NO: 126220 - RNA, 1701 nt, Artificial Sequence; identical to SEQ ID NO: 125787
  derived and/or modified sequence opt3 from hemagglutinin__InfluenzaA__ADD23072

SEQ ID NO: 126221 - RNA, 1701 nt, Artificial Sequence
  derived and/or modified sequence opt3 from hemagglutinin__InfluenzaA__ADD23082
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgauacuuacguguucgucggaaccucucgcuauuccaagaaauuuaagccugagauugcgauccgaccaaaagugcgugaccaggaggguagaaugaauuacuauuggacacugguggaacccggcgauaagauuacuuucgaggcaaccgggaaccuagucguuccuagguacgccuuugcuauggaacggaacgccggaagcggcaucauaauuucggacacaccagugcaugauugcaauaccacgugucaaacuccgaaaggugcaaucaacacaucucuccccuuccagaauauucacccuaucaccaucgggaagugcccaaaguauguaaaauccacuaagcugcgccuugcuacaggacugagaaacgugcccucaauucagaguaggggcuuguuuggcgccauagcgggguucaucgagggagguuggaccggcauggucgacgggugguacggauaucaucaccagaaugaacaaggcagcgguuacgccgcagaccucaaauccacgcagaacgcuauugaugagaucaccaauaaggugaacucuguuauagagaaaaugaauacacaguuuacugccguggggaaggaguucaaccaccuggagaagcggauugaaaauuuaaacaaaaaggucgacgauggcuuccuggacaucuggaccuacaaugcugagcuccuugugcuguuggaaaacgagcgcacacuagauuaucaugacagcaauguaaagaaccuguacgagaagguucgaucacagcucaaaaacaaugccaaggaaaucggaaacggcuguuuugaguucuaucacaagugcgauaauacuuguauggaaagugugaaaaacgggaccuacgacuauccuaaguacuccgaggaagcaaaacugaauagagaggagauugauggagucaaacuugaaagcacaaggaucuaucaaauucuggccauauacucuaccguggcuucaaguuugguccucgugguuagccugggugcgaucuccuuuuggaugugcucuaacggcucguuacagugccggauuuguaucuga

SEQ ID NO: 126222 - RNA, 1701 nt, Artificial Sequence
  derived and/or modified sequence opt3 from hemagglutinin__InfluenzaA__ADD23102
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaaaaguuugagauuuucccgaagacaagcuccuggcccaaucacgacucaaacaaaggggucaccgccgcuuguccucaugcaggagccaagaguuuuuauaaaaaucugaucuggcucgugaagaaaggcaacagcuacccaaaguuaucuaaguccuauauaaaugauaaaggcaaggaaguacugguucuuugggggauccaccaccccucaacgagcgcugaccaacagaguuuguaccagaacgccgaugcguacguguucgucggaacuucucgguauuccaaaaaguuuaaaccugagauugcaauccgcccaaaggugcgagaccaggagggucguaugaauuacuauuggacccugguggaacccggcgauaaaauuacauucgaggccacugggaaccuagucguuccuagauacgcuuuugccauggaaaggaacgcaggaagcggcaucauaauuucggacaccccagugcaugauugcaauacaaccugucaaacgccgaagggugcuaucaacacuucucuccccuuccagaauauucacccuaucacaaucgggaagugcccaaaauauguaaaguccaccaaacugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaccucaaguccacccagaacgccauugaugagaucacgaauaaagugaacucuguuauagagaagaugaauacccaguuuacagcuguggggaaggaguucaaccaccuggagaaaaggauugaaaauuuaaacaagaaagucgacgauggcuuccuggacaucuggacuuacaaugccgagcuccuugugcuguuggaaaacgagcggacccuagauuaucaugacagcaauguaaagaaccuguacgagaaaguucgcucacagcucaagaacaaugcaaaggaaaucggaaacggcuguuuugaguucuaucacaaaugcgauaauacauguauggaaagugugaagaacgggacuuacgacuauccuaaauacuccgaggaagccaagcugaaucgagaggagauugauggagucaaacuugaaagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 126223 - RNA, 1701 nt, Artificial Sequence; identical to SEQ ID NO: 125787
  derived and/or modified sequence opt3 from hemagglutinin__InfluenzaA__ADD23112

SEQ ID NO: 126224 - RNA, 1701 nt, Artificial Sequence; identical to SEQ ID NO: 125787
  derived and/or modified sequence opt3 from hemagglutinin__InfluenzaA__ADD23122

SEQ ID NO: 126225 - RNA, 1701 nt, Artificial Sequence; identical to SEQ ID NO: 124685
  derived and/or modified sequence opt3 from hemagglutinin__InfluenzaA__ADD23132

SEQ ID NO: 126226 - RNA, 1701 nt, Artificial Sequence; identical to SEQ ID NO: 125849
  derived and/or modified sequence opt3 from hemagglutinin__InfluenzaA__ADD23142

SEQ ID NO: 126227 - RNA, 1701 nt, Artificial Sequence
  derived and/or modified sequence opt3 from hemagglutinin__InfluenzaA__ADD23162
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagggguuguaccagaacgccgacgcguacguguucgucggaaccagucgcuauucuaagaaauuuaagccugagauugcaauccgaccaaaagugcgugaucaggaggguagaaugaauuacuauuggacucugguggaacccggcgacaagauuacauucgaggccacugggaaccuagucguuccuagguacgcuuuugccauggaacggaacgcaggauccggcaucauaauuagcgauaccccagugcaugacugcaauacaaccugucaaacgccgaaaggugcuaucaacacuucgcuccccuuccagaauauucacccuaucacaaucgggaagugcccaaaguauguaaaaucuaccaagcugcgccuugccacuggacugagaaacgugcccuccauucagucaaggggcuuguuuggcgcgauagccggguucaucgagggagguuggacaggcauggucgacgggugguacggauaucaucaccagaaugaacaaggcagugguuacgcagcugaucucaaaagcacccagaacgccauugacaagaucacgaauaaagugaacuccguuauagagaagaugaauacccaguuuacagcuguggggaaggaguucaaccaccuggaaaaacggauugagaauuuaaacaagaaagucgaugacggcuuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggaaacggcuguuuugaguucuaucacaaaugcgacaauacauguauggagucagugaagaacgggacuuacgauuauccuaaauacagugaagaggccaagcugaauagagaagagauugacggagucaaacuugaguccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 126228 - RNA, 1701 nt, Artificial Sequence; identical to SEQ ID NO: 125849
  derived and/or modified sequence opt3 from hemagglutinin__InfluenzaA__ADD23172

SEQ ID NO: 126229 - RNA, 1701 nt, Artificial Sequence; identical to SEQ ID NO: 125849
  derived and/or modified sequence opt3 from hemagglutinin__InfluenzaA__ADD23182

SEQ ID NO: 126230 - RNA, 1701 nt, Artificial Sequence; identical to SEQ ID NO: 125849
  derived and/or modified sequence opt3 from hemagglutinin__InfluenzaA__ADD23192

SEQ ID NO: 126231 - RNA, 1701 nt, Artificial Sequence; identical to SEQ ID NO: 125849
  derived and/or modified sequence opt3 from hemagglutinin__InfluenzaA__ADD23202

SEQ ID NO: 126232 - RNA, 1701 nt, Artificial Sequence; identical to SEQ ID NO: 125849
  derived and/or modified sequence opt3 from hemagglutinin__InfluenzaA__ADD23220

SEQ ID NO: 126233 - RNA, 1701 nt, Artificial Sequence; identical to SEQ ID NO: 125845
  derived and/or modified sequence opt3 from hemagglutinin__InfluenzaA__ADD23230

SEQ ID NO: 126234 - RNA, 1701 nt, Artificial Sequence; identical to SEQ ID NO: 125849
  derived and/or modified sequence opt3 from hemagglutinin__InfluenzaA__ADD23240

SEQ ID NO: 126235 - RNA, 1701 nt, Artificial Sequence
  derived and/or modified sequence opt3 from hemagglutinin__InfluenzaA__ADD23260
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccggagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacaaaaucacgaauaaggugaacucuguuauagagaaaaugaauacccaguuuacagcuguggguaaggaguucaaccaccuggagaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126236 - RNA, 1701 nt, Artificial Sequence; identical to SEQ ID NO: 125038
  derived and/or modified sequence opt3 from hemagglutinin__InfluenzaA__ADD23280

SEQ ID NO: 126237 - RNA, 1701 nt, Artificial Sequence
  derived and/or modified sequence opt3 from hemagglutinin__InfluenzaA__ADD23290
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126238 - RNA, 1701 nt, Artificial Sequence; identical to SEQ ID NO: 125849
  derived and/or modified sequence opt3 from hemagglutinin__InfluenzaA__ADD23300

SEQ ID NO: 126239 - RNA, 1701 nt, Artificial Sequence; identical to SEQ ID NO: 126237
  derived and/or modified sequence opt3 from hemagglutinin__InfluenzaA__ADD23310

SEQ ID NO: 126240 - RNA, 1701 nt, Artificial Sequence; identical to SEQ ID NO: 125849
  derived and/or modified sequence opt3 from hemagglutinin__InfluenzaA__ADD23320

SEQ ID NO: 126241 - RNA, 1701 nt, Artificial Sequence
  derived and/or modified sequence opt3 from hemagglutinin__InfluenzaA__ADD23330
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagacaaaugcaaaggagaucggcaacggauguuuugaguucuaucacaaaugcgauaauacuuguauggaaagugugaagaacggcaccuacgacuauccuaaauacuccgaagaggccaagcugaauagagaagagauugauggggucaaacuugagagcacaaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 126242 - RNA, 1701 nt, Artificial Sequence
  derived and/or modified sequence opt3 from hemagglutinin__InfluenzaA__ADD23355
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaaauguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgguauuccaagaaauuuaagccugagauugcaauccgcccaaaagugcgagaccaggagggacguaugaacuacuauuggacccugguggaacccggugauaagauuacauucgaggccacuggcaaccuagucguuccuagauacgcuuuugccauggaaaggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcggcuugccacugggcugcgcaaugugcccucaauucagaguagaggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggagaaaaggauugagaacuuaaauaagaaagucgacgauggguuccuggacaucuggacuuacaacgccgaacuccuugugcuguuggagaaugaacggacccuagauuaucaugacagcaacguaaagaaccuguacgagaaaguucgcucacagcucaagaauaacgcaaaggagaucggcaauggauguuuugaguucuaucacaaaugcgauaacacauguauggagagugugaagaauggcacuuacgacuauccuaaauacuccgaagaggccaagcugaaccgagaagagauugauggggucaaacuugagagcaccagaaucuaucaaauucuggcuauauacucuacaguggcgucaaguuugguccucgugguuagccugggagcaaucuccuuuuggaugugcucuaaugguucguuacagugcaggauuuguaucuga

SEQ ID NO: 126243 - RNA, 1701 nt, Artificial Sequence; identical to SEQ ID NO: 126237
  derived and/or modified sequence opt3 from hemagglutinin__InfluenzaA__ADD23375

SEQ ID NO: 126244 - RNA, 1701 nt, Artificial Sequence; identical to SEQ ID NO: 125849
  derived and/or modified sequence opt3 from hemagglutinin__InfluenzaA__ADD23385

SEQ ID NO: 126245 - RNA, 1701 nt, Artificial Sequence
  derived and/or modified sequence opt3 from hemagglutinin__InfluenzaA__ADD23405
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaguagguaagugcccaaaguaugugaaauccaccaagcugcgccuugccacugggcugagaaauguccccucaauccagaguaggggauuguuuggcgcgauugccggcuucauagaagggggauggacagguaugguggacggcugguacggguaucaucaccagaacgaacaaggaagcggcuacgcagcugaccucaaauccacccagaaugccaucgauaagauuacgaacaaaguuaauucugugaucgagaagaugaacacccaguuuacagcugucgguaaggaguucaaucaccuggaaaaacggauagagaacuuaaauaagaaaguggacgauggguuccuggacauuuggacuuacaacgccgaacuccuuguacuguuggagaaugaacgcacccuagauuaucaugacagcaacguuaagaaccuguacgagaaagugcgaucacagcucaagaauaacgcaaaggagaucggcaauggauguuuugaguucuaucacaaaugcgauaacacauguauggaaagugucaagaauggcacuuacgacuauccuaaauacuccgaagaggccaagcugaacagagaagagaucgauggggugaaacuugagagcaccaggauuuaucaaauccuggcuauuuacucuacagucgcgucaaguuuggugcucguugugagccugggagcaauauccuuuuggaugugcucuaaugguucguuacagugccggaucuguauuuga

SEQ ID NO: 126246 - RNA, 1701 nt, Artificial Sequence
  derived and/or modified sequence opt3 from hemagglutinin__InfluenzaA__ADD23415
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagagagcgggaucauaauuucggacaccccagugcaugauugcaacacaaccugucaaacgccgaaaggagcuaucaauacuucucuccccuuccagaacauucacccuaucacaaucggcaagugcccaaaguauguaaaauccaccaagcugcgccuugccacuggucugagaaaugugcccucaauucagaguaggggguuguuuggagcgauagccggcuucaucgaaggcggguggacaggaauggucgacgguugguacggcuaucaucaccagaacgagcaagggagcggauacgcagcugaccucaaauccacccagaaugccauugauaagaucacgaacaaaguuaauucugugauagagaagaugaacacccaguuuacagcugugggcaaggaguucaaucaccuggagaaacggauugaaaacuuaaauaagaaagucgacgaugguuuccuggacaucuggacuuacaacgccgagcuccuugugcuguuggaaaaugagcgcacccuagauuaucaugacagcaacguaaagaaccuguacgagaaaguucgaucacagcucaagaauaacgcaaaggaaaucgggaauggcuguuuugaguucuaucacaaaugcgauaacacauguauggaaagugugaagaauggaacuuacgacuauccuaaauacuccgaggaagccaagcugaacagagaggagauugauggcgucaaacuugaaagcaccaggaucuaucaaauucuggcuauauacucuacaguggcgucaaguuugguccucgugguuagccugggggcaaucuccuuuuggaugugcucuaauggaucguuacagugccggauuuguaucuga

SEQ ID NO: 126247 - RNA, 1701 nt, Artificial Sequence; identical to SEQ ID NO: 125849
  derived and/or modified sequence opt3 from hemagglutinin__InfluenzaA__ADD23435

SEQ ID NO: 126248 - RNA, 1701 nt, Artificial Sequence
  derived and/or modified sequence opt3 from hemagglutinin__InfluenzaA__ADD23465
augaaggccauccuggcugugcuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 126249 - RNA, 1701 nt, Artificial Sequence; identical to SEQ ID NO: 125849
  derived and/or modified sequence opt3 from hemagglutinin__InfluenzaA__ADD23475

SEQ ID NO: 126250 - RNA, 1701 nt, Artificial Sequence; identical to SEQ ID NO: 125849
  derived and/or modified sequence opt3 from hemagglutinin__InfluenzaA__ADD23485

SEQ ID NO: 126251 - RNA, 1701 nt, Artificial Sequence
  derived and/or modified sequence opt3 from hemagglutinin__InfluenzaA__ADD23495
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggcccgcaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 126252 - RNA, 1701 nt, Artificial Sequence
  derived and/or modified sequence opt3 from hemagglutinin__InfluenzaA__ADD23505
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugauugaacccggugacaagaucacauucgaggccacuggcaaccuaguggucccuagguacgcuuuugccauggaacggaacgcagggagcggaauaauuaucucggauaccccagcucaugacugcaauacaaccugucaaacgccgaaaggcgccauuaacacuucucuccccuuccagaauauccacccuaucacaauugguaagugcccaaaguauguuaaauccaccaagcugcgccuugcgacugggcugagaaacgugcccucaauacagaguaggggauuguuuggcgccaucgcaggcuucauugaagggggauggacagguaugguagacggcugguacggguaucaucaccagaaugaacaaggaagcggcuacgcugccgaucucaaauccacccagaacgcuaucgacaagauaacgaauaaagugaacucugucauugagaagaugaauacccaguuuacagccguggguaaggaguucaaccaccuggaaaaacggaucgagaauuuaaacaagaaaguugaugacggguuccuggauaucuggacuuacaaugcagaacuccuugugcuguuggagaacgaacgcacccuagacuaucaugauagcaaugucaagaaccuguacgagaaagugcgaucacagcucaagaacaaugccaaggagauuggcaacggauguuuugaguucuaucacaaaugcgacaauacauguauggaaaguguaaagaacggcacuuacgauuauccuaaauacuccgaagaggcuaagcugaauagagaagagaucgacgggguuaaacuugagagcaccaggauuuaucaaauacuggcgaucuacucuacaguggcaucaaguuugguccucguggucagccugggagccauuuccuuuuggaugugcucuaacgguucguuacagugccggaucuguaucuga

SEQ ID NO: 126253 - RNA, 1701 nt, Artificial Sequence; identical to SEQ ID NO: 125849
  derived and/or modified sequence opt3 from hemagglutinin__InfluenzaA__ADD23515

SEQ ID NO: 126254 - RNA, 1701 nt, Artificial Sequence; identical to SEQ ID NO: 125849
  derived and/or modified sequence opt3 from hemagglutinin__InfluenzaA__ADD23994

SEQ ID NO: 126255 - RNA, 1701 nt, Artificial Sequence
  derived and/or modified sequence opt3 from hemagglutinin__InfluenzaA__ADD24004
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaacggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaaaucgaugacggguuccuggauaucuggacuuacaacgccgagcuccuuguccuguuggaaaaugagcgcacccuagacuaucaugauagcaacgugaagaaccuguacgagaaaguacgaucacagcucaagaauaacgcaaaagaaauuggcaauggauguuuugaguucuaucacaagugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126256 - RNA, 1701 nt, Artificial Sequence; identical to SEQ ID NO: 125787
  derived and/or modified sequence opt3 from hemagglutinin__InfluenzaA__ADD24014

SEQ ID NO: 126257 - RNA, 1701 nt, Artificial Sequence
  derived and/or modified sequence opt3 from hemagglutinin__InfluenzaA__ADD52537
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgguaucaccaauaaggugaacagcguuauagagaaaaugaauacgcaguuuaccgcuguggggaaggaguucaaccaccuggaaaagcggauugagaauuuaaacaaaaaggucgaugacggcuuccuggauaucuggacauacaaugccgaacuccuugugcuguuggagaacgaacgcacucuagacuaucaugauucaaauguaaagaaccuguacgagaagguucgaagucagcucaaaaacaaugcaaaggagaucggaaacggcuguuuugaguucuaucacaagugcgacaauaccuguauggaauccgugaaaaacgggacauacgauuauccuaaguacagcgaagaggccaaacugaauagagaagagauugacggagucaaacuugagucuacuaggaucuaucaaauucuggcuauauacucaaccguggcgaguagcuugguccucgugguuucccugggugcaaucucuuuuuggaugugcucgaacggcagcuuacagugccggauuuguaucuga

SEQ ID NO: 126258 - RNA, 1701 nt, Artificial Sequence; identical to SEQ ID NO: 125849
  derived and/or modified sequence opt3 from hemagglutinin__InfluenzaA__ADD64203

SEQ ID NO: 126259 - RNA, 1701 nt, Artificial Sequence
  derived and/or modified sequence opt3 from hemagglutinin__InfluenzaA__ADD64204
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugauugaaccuggugagaagaucacauucgaagccacuggcaaccuaguggucccaagguacgcuuuugccauggagcggaacgcaggguccggaauaauuaucagcgacaccccgguucaugauugcaauacaaccugucaaacgcccaaaggcgcuauuaacacuucgcucccuuuccagaauauccacccaaucacaauugguaagugccccaaguaugugaaaucuaccaagcugcgccuugccacugggcugagaaacguaccuuccauacagucaaggggauuguuuggcgcgaucgccggcuucauugaagggggauggacagguaugguggacggcugguacggguaucaucaccagaaugagcaaggaaguggcuacgcagcugaccucaaaagcacccagaacgccaucgaugagauaacgaauaaggucaacuccgugauugagaaaaugaauacccaguuuacagcuguugguaaggaguucaaccaccuggaaaagcggaucgagaauuuaaacaaaaagguggacgauggguuccuggacaucuggacuuacaaugccgaacuccuuguccuguuggagaacgagcgcacccuagauuaucaugacucuaaugugaaaaaccuguacgaaaagguacgaagccagcucaaaaacaaugcaagagagauuggcaacggauguuuugaguucuaucacaagugcgauaauacauguauggaaucaguuaagaacggcacuuacgacuauccaaaauacagugaagaggccaagcugaauagggaggaaaucgauggggugaaacuugaguccacccggauuuaucaaauacuggcuaucuacagcacagucgcgucuucauuggugcucgucgugagucugggagcaauuagcuuuuggaugugcuccaacgguucuuuacagugccguaucuguaucuga

SEQ ID NO: 126260 - RNA, 1701 nt, Artificial Sequence; identical to SEQ ID NO: 124685
  derived and/or modified sequence opt3 from hemagglutinin__InfluenzaA__ADD64205

SEQ ID NO: 126261 - RNA, 1701 nt, Artificial Sequence; identical to SEQ ID NO: 124685
  derived and/or modified sequence opt3 from hemagglutinin__InfluenzaA__ADD64206

SEQ ID NO: 126262 - RNA, 1701 nt, Artificial Sequence; identical to SEQ ID NO: 125483
  derived and/or modified sequence opt3 from hemagglutinin__InfluenzaA__ADD64207

SEQ ID NO: 126263 - RNA, 1701 nt, Artificial Sequence
  derived and/or modified sequence opt3 from hemagglutinin__InfluenzaA__ADD64208
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauccaaauguaaagaaccuguacgagaagguucgaucucagcucaaaaacaaugcaaaggaaaucggcaacggauguuuugaguucuaucacaagugcgacaauacauguauggaaagcgugaaaaacggcacuuacgauuaucccaaguacucagaggaagccaaacugaauagagaggagauugacggggucaaacuugaaaguaccaggaucuaucaaauucuggcuauauacuccacaguggcgagcucuuugguccucgugguuucacugggagcaaucaguuuuuggaugugcagcaacgguuccuuacagugccggauuuguaucuga

SEQ ID NO: 126264 - RNA, 1701 nt, Artificial Sequence; identical to SEQ ID NO: 125483
  derived and/or modified sequence opt3 from hemagglutinin__InfluenzaA__ADD64209

SEQ ID NO: 126265 - RNA, 1701 nt, Artificial Sequence; identical to SEQ ID NO: 124685
  derived and/or modified sequence opt3 from hemagglutinin__InfluenzaA__ADD64210

SEQ ID NO: 126266 - RNA, 1701 nt, Artificial Sequence; identical to SEQ ID NO: 125483
  derived and/or modified sequence opt3 from hemagglutinin__InfluenzaA__ADD64211

SEQ ID NO: 126267 - RNA, 1701 nt, Artificial Sequence; identical to SEQ ID NO: 124685
  derived and/or modified sequence opt3 from hemagglutinin__InfluenzaA__ADD64212

SEQ ID NO: 126268 - RNA, 1701 nt, Artificial Sequence; identical to SEQ ID NO: 125483
  derived and/or modified sequence opt3 from hemagglutinin__InfluenzaA__ADD64213

SEQ ID NO: 126269 - RNA, 1701 nt, Artificial Sequence
  derived and/or modified sequence opt3 from hemagglutinin__InfluenzaA__ADD64214
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaaaauaagcacaacgggaaacuauguaagcucagaggaguggcuccccugcaucuugguaaaugcaauauagccggcuggauccuggggaacccugagugugaaucuuuuucaacaaguagcuccuggucuuacauuguugagaccucgucaagcgauaauggaacuugcuauccaggcgacuucaucgauuacgaagaguugagggagcagcucaguuccgugucuagcuuugaacgguucgagauuuuuccgaagacauccucauggcccaaccacgacaguaauaagggugucaccgcagccuguccucaugcuggggcaaagagcuucuauaaaaaccugaucuggcuggugaaaaagggaaauucuuacccaaaacucaacaaguccuauauaaaugauaagggcaaagaaguauuaguucuguggggcauccaccaccccucaacgagcgccgaccaacagagucuuuaccagaacgcugaugccuacguguuugucgggacuucucgcuauuccaagaaauucaagccugagauugcgauccgaccaaaagugcgugaccaggagggaagaaugaacuacuauuggaccuugguggaacccggugauaagauuacauuugaggcaacuggcaaucuggucguuccuagguacgccuucgcuauggaacggaacgccgggagcggaaucauaauuucggacaccccagugcaugauugcaauacaaccugucaaacgccgaaaggcgcaaucaacacuucucuacccuuucagaauauucacccuaucacaaucgguaagugcccaaaguauguaaaauccaccaagcuccgccuggcuacugggcuuagaaacgugcccucaauucagaguaggggacuguucggcgccauagcgggcuuuaucgaagggggauggacagguauggucgacggcugguacggguaucaucaccagaaugagcaaggaagcggcuacgccgcagacuugaaauccacccagaacgcuauugaugguaucacgaauaaggugaacucuguuauagagaaaaugaauacccaguucacagccguggggaaggaguucaaccaccucgaaaagcggauugagaaucugaacaaaaaggucgacgauggcuuuuuagacaucuggacuuacaaugcugaacugcucgugcuucuggagaacgaacgcaccuuggauuaucaugacagcaacguuaaaaaucuauacgagaagguacgaucacagcugaaaaacaaugccaaggagaucggaaacggcuguuucgaauuuuaucacaagugcgauaauacauguauggagagugugaaaaacgggacuuacgacuauccuaaguacuccgaagaggcaaaacucaauagagaagagauugauggagucaagcuggagagcaccaggaucuaucaaauucuugccauauacucuacaguggcuucaagucuggucuuggugguuagccucggugcgaucuccuucuggaugugcucuaacggcucgcugcagugccggauuuguaucuga

SEQ ID NO: 126270 - RNA, 1701 nt, Artificial Sequence; identical to SEQ ID NO: 124685
  derived and/or modified sequence opt3 from hemagglutinin__InfluenzaA__ADD64215

SEQ ID NO: 126271 - RNA, 1701 nt, Artificial Sequence; identical to SEQ ID NO: 125483
  derived and/or modified sequence opt3 from hemagglutinin__InfluenzaA__ADD64216

SEQ ID NO: 126272 - RNA, 1701 nt, Artificial Sequence; identical to SEQ ID NO: 125483
  derived and/or modified sequence opt3 from hemagglutinin__InfluenzaA__ADD64217

SEQ ID NO: 126273 - RNA, 1701 nt, Artificial Sequence
  derived and/or modified sequence opt3 from hemagglutinin__InfluenzaA__ADD74350
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguagucaugcaggggccaagagcuuuuauaaaaaucugauauggcuggugaaaaagggaaacucuuacccuaaacucuccaagucauauaucaaugacaagggcaaagaaguauuaguucuguggggcauucaccacccaagcacgagugcugaucaacagucucuuuaccagaacgccgacgcguacguguucgucggguccagccgcuauucgaagaaauuuaagcccgagaucgcaauucgaccuaaagugcgugaucaggagggaagaaugaauuacuauuggacuuugguggaaccaggugacaagaucaccuucgaggccacaggcaaccuggucguucccagguacgcuuuugccauggaacggaacgcagggucuggaauaauuaucuccgauacuccugugcaugacugcaauaccacaugucaaaccccaaaaggcgcuauuaacacgucacuaccguuccagaauauccaccccaucacuauugguaagugcccuaaguauguaaaaaguacaaagcuccgccuggccaccgggcuuagaaacgugccaagcauacaguccaggggacuguuuggcgcgaucgccggcuucauugaagggggauggacugguauggucgacggcugguacggguaucaucaccagaaugaacaaggaucuggcuacgcagcugauuugaaaagcacacagaacgccaucgacgagauaaccaauaaggugaacucaguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauaguaauguuaaaaaccuauacgagaagguacgaucccagcugaaaaacaaugcaaaggaaauuggcaacggauguuuugaguucuaucacaagugcgacaauaccuguauggaaagcgugaaaaacggcacauacgauuaucccaaguacucugaggaagccaaacucaauagagaggagaucgacggggucaagcuggaaucaacuaggauuuaucaaauacuugcuaucuacaguaccguggcgagcucccuggucuuggugguuucucucggagcaauuucguuuuggaugugcagcaacgguucccugcagugccggaucuguaucuga

SEQ ID NO: 126274 - RNA, 1701 nt, Artificial Sequence
  derived and/or modified sequence opt3 from hemagglutinin__InfluenzaA__ADD74360
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagcgcaaagaaguacugguucuuuggggcauccaccaccccucaacgagcgcugaucaacagaguuuguaccagaacgccgacgcguacguguucgucggcacuucucgauauuccaagaaauuuaagccugagauugcaauccguccaaaagugagagaucaggaggggaggaugaauuacuauuggacccugguggaacccggagacaagauuacauucgaggccacugguaaccuagucguuccucgguacgcuuuugccauggaacgcaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugagacuugccacuggucugaggaacgugcccucaauucagagucggggguuguuuggagcgauagccggcuucaucgagggcggguggacaggaauggucgacgguugguacggcuaucaucaccagaaugaacaagggagcggauacgcagcugaucucaaauccacccagaacgccauugacgagaucacgaauaaggugaacucuguuauagagaaaaugaauacccaguuuacagcugugggcaaggaguucaaccaccuggagaagcgcauugaaaauuuaaacaaaaaggucgaugacgguuuccuggauaucuggacuuacaaugccgagcuccuugugcuguuggaaaacgagcgaacccuagacuaucaugauagcaauguaaagaaccuguacgagaagguuagaucacagcucaaaaacaaugcaaaggaaaucgggaacggcuguuuugaguucuaucacaagugcgacaauacauguauggaaagugugaaaaacggaacuuacgauuauccuaaguacuccgaggaagccaaacugaauagggaggagauugacggcgucaaacuugaaagcacccggaucuaucaaauucuggcuauauacucuacaguggcgucaaguuugguccucgugguuagccugggggcaaucuccuuuuggaugugcucuaacggaucguuacagugccguauuuguaucuga

SEQ ID NO: 126275 - RNA, 1701 nt, Artificial Sequence; identical to SEQ ID NO: 124685
  derived and/or modified sequence opt3 from hemagglutinin__InfluenzaA__ADD74370

SEQ ID NO: 126276 - RNA, 1701 nt, Artificial Sequence; identical to SEQ ID NO: 124685
  derived and/or modified sequence opt3 from hemagglutinin__InfluenzaA__ADD74398

SEQ ID NO: 126277 - RNA, 1701 nt, Artificial Sequence
  derived and/or modified sequence opt3 from hemagglutinin__InfluenzaA__ADD74428
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccuggugaagcccggugauaaaauuacauucgaagccacuggcaaccuagucguuccuagguacgcuuuugccauggagcggaaugcagggagcggaaucauaauuucggacaccccagugcaugauugcaacacaaccugucaaacgccgaagggcgcuaucaauacuucucuccccuuccagaacauucacccuaucacaaucgguaagugcccaaaauauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaccucaaguccacccagaaugccauugauaaaaucacgaacaagguaaauucuguuauagaaaagaugaacacccaguuuacagcuguggguaaagaguucaaucaccuggagaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgaaaagguucgaucacagcucaagaauaacgcaaaagagaucggcaauggauguuuugaguucuaucacaagugcgauaacacauguauggaaagugugaaaaauggcacuuacgacuauccuaaguacuccgaggaagccaaacugaacagagaggaaauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126278 - RNA, 1701 nt, Artificial Sequence
  derived and/or modified sequence opt3 from hemagglutinin__InfluenzaA__ADD74438
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaccaaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 126279 - RNA, 1701 nt, Artificial Sequence; identical to SEQ ID NO: 124685
  derived and/or modified sequence opt3 from hemagglutinin__InfluenzaA__ADD74448

SEQ ID NO: 126280 - RNA, 1701 nt, Artificial Sequence; identical to SEQ ID NO: 124685
  derived and/or modified sequence opt3 from hemagglutinin__InfluenzaA__ADD74458

SEQ ID NO: 126281 - RNA, 1701 nt, Artificial Sequence
  derived and/or modified sequence opt3 from hemagglutinin__InfluenzaA__ADD74468
augaaggccauccuggugguccuccuuuacaccuucgcuacagcaaacgccgacacucugugcauuggcuaucacgcgaauaacagcacggauaccguugacacaguguuggagaagaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauuaccauccgaccaaaagugcgugaccaggagggaagaaugaacuacuauuggacacugguggaacccggugauaagauuacuuucgaggcaaccggcaaucuagucguuccuagguacgccuuugcuauggaacggaacgccgggagcggaaucauaauuucggacacaccagugcaugacugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgauggcugguacggguaucaucaccagaacgaacaaggaagcggcuacgccgcagaccucaaauccacgcagaaugcuauugaugagaucaccaacaagguaaauucuguuauagagaaaaugaacacacaguuuacugccguggguaaggaguucaaucaccuggaaaagcggauugaaaacuuaaauaaaaaggucgacgauggguuccuggacaucuggaccuacaacgcugagcuccuugugcuguuggaaaaugagcgcacacuagauuaucaugacagcaacgugaaaaaucuguacgagaagguucgaucacagcucaaaaacaacgccaaggaaaucggcaauggauguuuugaguucuaucacaagugcgauaacacuuguauggaaagugugaaaaauggcaccuacgacuauccuaaguacuccgaggaagcaaaacugaacagagaggagauugauggggucaaacuugaaagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 126282 - RNA, 1701 nt, Artificial Sequence
  derived and/or modified sequence opt3 from hemagglutinin__InfluenzaA__ADD74488
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 126283 - RNA, 1701 nt, Artificial Sequence; identical to SEQ ID NO: 124685
  derived and/or modified sequence opt3 from hemagglutinin__InfluenzaA__ADD74498

SEQ ID NO: 126284 - RNA, 1701 nt, Artificial Sequence
  derived and/or modified sequence opt3 from hemagglutinin__InfluenzaA__ADD74508
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcagaagccaaaaguuuuuauaagaaccugaucuggcucgugaaaaaggggaauagcuacccaaaauuaucuaaguccuauauaaacgauaagggaaaagagguacugguucuuuggggcauccaccaccccucaacgagcgcugaccaacagaguuuguaccagaaugccgaugcguacguguucgucggcacuucucgcuauuccaagaaauuuaagccugagauugcaauccgaccaaaagugcgugaccaggaagggagaaugaacuacuauuggacccugguggagcccggagauaagauuacauucgaagccacugguaaucuagucguuccuagguacgcuuuugccauggagcggaacgcaggcagcgggaucauaauuucggacaccccagugcaugacugcaacacaaccugucaaacgccgaaaggagcuaucaauacuucucuccccuuccagaacauucacccuaucacaaucggcaagugcccaaaguauguaaaauccaccaagcugcgccuugccacuggucugagaaaugugcccucaauucagaguaggggguuguuuggagcgauagccggcuucaucgaaggcggguggacaggaauggucgaugguugguacggcuaucaucaccagaacgagcaagggagcggauacgcagcugaccucaaauccacccagaaugccauugaugagaucacgaacaagguaaauucuguuauagaaaagaugaacacccaguuuacagcugugggcaaggaguucaaucaccuggaaaagcggauugagaacuuaaauaaaaaggucgacgaugguuuccuggacaucuggacuuacaacgccgaacuccuugugcuguuggagaaugagcgcacccuagauuaucaugacagcaacgugaaaaaucuguacgaaaagguucgaucacagcucaaaaacaacgcaaaggagaucgggaauggcuguuuugaguucuaucacaagugcgauaacacauguauggagagugugaaaaauggaacuuacgacuauccuaaguacuccgaagaggccaaacugaacagagaggaaauugauggcgucaaacuugagagcaccaggaucuaucaaauucuggcuauauacucuacaguggcgucaaguuugguccucgugguuagccugggggcaaucuccuuuuggaugugcucuaauggaucguuacagugccggauuuguaucuga

SEQ ID NO: 126285 - RNA, 1701 nt, Artificial Sequence
  derived and/or modified sequence opt3 from hemagglutinin__InfluenzaA__ADD74518
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggaacggaacaccgggagcggaauuaucauuucggauacaccaguccaugacugcaauaccacgugucaaacuccgaaaggcgcaaucaacacaucucuccccuuccagaauauccacccuauuaccauagguaagugcccaaaguauguuaaauccacuaagcugcgccuugcuacagggcugagaaacgugcccucaauccagaguaggggauuguuuggcgccauugcgggcuucaucgaagggggauggaccgguaugguagacggcugguacggguaucaucaccagaaugaacaaggaagcggcuacgccgcagaucucaaauccacgcagaacgcuauagacgagauuaccaauaaggugaacucugucaucgagaaaaugaauacacaguuuacugccguggguaaggaguucaaccaccuggaaaagcggaucgaaaauuuaaacaaaaagguugaugacggguuccuggauauuuggaccuacaaugcugagcuccuugugcuguuggaaaacgagcgcacacuagacuaucaugauagcaaugucaaaaaccuguacgagaaggugcgaucacagcucaaaaacaaugccaaggaaaucggcaacggauguuuugaguucuaucacaagugcgacaauacuuguauggaaaguguaaagaacggcaccuacgauuauccuaaguacuccgaggaagcaaaacugaauagagaggagauugacgggguuaaacuugaaagcacaaggauauaucaaauccuggccauuuacucuaccguggcuucaaguuugguccucguggucagccugggagcgaucuccuuuuggaugugcucuaacgguucguuacagugccggaucuguauuuga

SEQ ID NO: 126286 - RNA, 1701 nt, Artificial Sequence
  derived and/or modified sequence opt3 from hemagglutinin__InfluenzaA__ADD74528
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuucagccugagauugcaauccgaccaaaggugcgugaccaagagggaagaaugaacuacuauuggacccugguggaacccggugauaaaauuacauucgaggccacuggcaaccuagucguuccuagguacgcuuuugccauggaacggaaugcagggagcggaaucauaauuucggacaccccagugcaugauugcaacacaaccugucagacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccaaaacgaacagggaagcggcuacgcagcugaccucaaguccacccagaaugccauugauaaaaucacgaacaagguaaauucuguuauagagaaaaugaacacccaguuuacagcuguggguaaggaguucaaucaccuggaaaagcggauugagaacuuaaauaaaaaggucgacgauggguuccuggacaucuggacuuacaacgccgaacuccuugugcuguuggagaaugaacgcacccuagauuaucaugacagcaacgugaaaaaccuguacgagaagguucgaucacaacucaaaaauaacgcaaaggagaucggcaauggauguuuugaguucuaucacaagugcgauaacacauguauggaaagugugaaaaauggcacuuacgacuauccuaaguacuccgaagaggccaaacugaacagagaagagauugauggggucaaacuugagagcaccaggaucuaucagauucuggcuauauacucuacaguggcgucaaguuugguccucgugguuagccugggagcaaucuccuuuuggaugugcucuaaugguucguuacagugccggauuuguaucuga

SEQ ID NO: 126287 - RNA, 1701 nt, Artificial Sequence
  derived and/or modified sequence opt3 from hemagglutinin__InfluenzaA__ADD74538
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguagacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccaguguaugacugcaauacaaccugucaaacgccgaagggcgcuaucaacacuucucuccccuuccagaauauucauccuaucacaaucgguaaaugcccaaaguacguaaaguccaccaaacugagacuugccacugggcugaggaacgugcccucaauucagagucggggauuguuuggcgcgauagccggcuucaucgaagggggauggacagguauggucgacggcugguauggguaccaccaucagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuauaaugccgagcuccuugugcuguuggaaaacgagcgaacccuagacuaccacgauagcaauguaaagaaccuguaugagaaaguuagaucacagcucaagaacaaugcaaaagaaaucggcaacggauguuuugaguucuaccauaagugcgacaauacauguauggaaagugugaagaacggcacuuaugauuacccuaaauauuccgaggaagccaagcugaauagggaggagauugacggggucaaacuugaaagcacccggaucuaccaaauucuggcuauauacucuacaguggcgucaaguuugguccucgugguuagccugggagcaaucuccuuuuggaugugcucuaacgguucguuacagugccguauuuguaucuga

SEQ ID NO: 126288 - RNA, 1701 nt, Artificial Sequence; identical to SEQ ID NO: 126282
  derived and/or modified sequence opt3 from hemagglutinin__InfluenzaA__ADD74548

SEQ ID NO: 126289 - RNA, 1701 nt, Artificial Sequence; identical to SEQ ID NO: 125849
  derived and/or modified sequence opt3 from hemagglutinin__InfluenzaA__ADD74558

SEQ ID NO: 126290 - RNA, 1701 nt, Artificial Sequence; identical to SEQ ID NO: 126237
  derived and/or modified sequence opt3 from hemagglutinin__InfluenzaA__ADD74568

SEQ ID NO: 126291 - RNA, 1701 nt, Artificial Sequence
  derived and/or modified sequence opt3 from hemagglutinin__InfluenzaA__ADD74578
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaguagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcauccaccaccccagcacgaguacugaucaacagucuuuguaccagaacgccgacgcuuacguguucgucgggaccucccgcuauagcaagaaauuuaagccugagauugccauccgaccaaaagugcgugaucaggagggaagaaugaauuacuauuggacacugguggaacccggugacaagauuacuuucgaggcgaccggcaaccuagucguuccuagguacgcauuugccauggaacggaacgcugggucgggaaucauaauuucugauacaccagugcaugacugcaauaccacgugucaaacuccgaaaggcgccaucaacacaucccuccccuuccagaauauucacccuaucaccaucgguaagugcccaaaguauguaaaaucaacuaagcugcgccuugcaacagggcugagaaacgugcccaguauucagagcaggggauuguuuggcgcuauagccggcuucaucgaagggggauggaccgguauggucgacggcugguacggguaucaucaccagaaugaacaaggauccggcuacgcggccgaucucaaaucuacgcagaacgcaauugacgagaucaccaauaaggugaacagcguuauagagaaaaugaauacacaguuuacugcuguggguaaggaguucaaccaccuggaaaagcggauugaaaauuuaaacaaaaaggucgaugacggguuccuggauaucuggaccuacaaugccgagcuccuugugcuguuggaaaacgagcgcacacuagacuaucaugauucaaauguuaaaaaccuguacgagaagguacgaagucagcucaaaaacaaugcuaaggaaaucggcaacggauguuuugaguucuaucacaagugcgacaauacuuguauggaauccgugaaaaacggcaccuacgauuauccuaaguacagcgaggaagccaaacugaauagagaggagauugacggggucaaacuugaaucuacaaggaucuaucaaauucuggcaauauacucaaccguggccaguagcuugguccucgugguuucccugggagcuaucucuuuuuggaugugcucgaacgguagcuuacagugccggauuuguaucuga

SEQ ID NO: 126292 - RNA, 1701 nt, Artificial Sequence
  derived and/or modified sequence opt3 from hemagglutinin__InfluenzaA__ADD74588
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgaugggcaacagaguuuguaccagaacgcugacgccuacguguucgucggaacuucucgcuauuccaagaaauuuaagccugagauugcgauccgaccaaaagugcgugaucaggaggguagaaugaauuacuauuggacccugguggaacccggcgacaagauuacauucgaggcaacugggaaccuagucguuccuagguacgccuuugcuauggaacggaacgccggaagcggcaucauaauuucggauaccccagugcaugacugcaauacaaccugucaaacgccgaaaggugcaaucaacacuucucuccccuuccagaauauucacccuaucacaaucgggaagugcccaaaguauguaaaauccaccaagcugcgccuugcuacuggacugagaaacgugcccucaauucagaguaggggcuuguuuggcgccauagcgggguucaucgagggagguuggacaggcauggucgacgggugguacggauaucaucaccagaaugaacaaggcagcgguuacgccgcagaucucaaauccacccagaacgcuauugacgagaucacgaauaaggugaacucuguuauagagaaaaugaauacccaguuuacagccguggggaaggaguucaaccaccuggagaagcggauugaaaauuuaaacaaaaaggucgaugacggcuuccuggauaucuggacuuacaaugcugagcuccuugugcuguuggaaaacgagcgcacccuagacuaucaugauagcaauguuaaaaaccuguacgagaagguacgaucacagcucaaaaacaaugccaaggaaaucggaaacggcuguuuugaguucuaucacaagugcgacaauacauguauggaaagugugaaaaacgggacuuacgauuauccuaaguacuccaaagaggcaaagcugaauagagaagagauugacggagucaaacuugagagcaccaggaucuaucaaauucuggccauauacucuacaguggcuucaaguuugguccucgugguuagccugggugcgaucuccuuuuggaugugcucuaacggcucguuacagugccggauuuguaucuga

SEQ ID NO: 126293 - RNA, 1701 nt, Artificial Sequence; identical to SEQ ID NO: 126237
  derived and/or modified sequence opt3 from hemagglutinin__InfluenzaA__ADD74598

SEQ ID NO: 126294 - RNA, 1701 nt, Artificial Sequence; identical to SEQ ID NO: 126237
  derived and/or modified sequence opt3 from hemagglutinin__InfluenzaA__ADD74608

SEQ ID NO: 126295 - RNA, 1701 nt, Artificial Sequence; identical to SEQ ID NO: 125849
  derived and/or modified sequence opt3 from hemagglutinin__InfluenzaA__ADD74618

SEQ ID NO: 126296 - RNA, 1701 nt, Artificial Sequence
  derived and/or modified sequence opt3 from hemagglutinin__InfluenzaA__ADD74628
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggagaaaaacgcagggagcggaauuaucauuucggauaccccaguccaugacugcaauacaaccugucaaacgccgaagggcgcuaucaacacuucucuccccuuccagaauauccacccuauuacaauagguaagugcccaaaauauguuaaguccaccaaacugcggcuugccacugggcugcgcaacgugcccucaauccagaguagaggauuguuuggcgcgauugccggcuucaucgaagggggauggacagguaugguagacggcugguacggguaucaucaccagaaugaacaaggaagcggcuacgcagcugaucucaaguccacccagaacgccauagacgagauuacgaauaaagugaacucugucaucgagaagaugaauacccaguuuacagcuguggguaaggaguucaaccaccuggagaaaaggaucgaaaauuuaaacaagaaaguugaugacggguuccuggauauuuggacuuacaaugccgagcuccuugugcuguuggaaaacgagcggacccuagacuaucaugauagcaaugucaagaaccuguacgagaaagugcgcucacagcucaagaacaaugcaaaggaaaucggcaacggauguuuugaguucuaucacaaaugcgacaauacauguauggaaaguguaaagaacggcacuuacgauuauccuaaauacuccgaggaagccaagcugaaucgagaggagauugacgggguuaaacuugaaagcaccagaauauaucaaauccuggcuauuuacucuacaguggcgucaaguuugguccucguggucagccugggagcaaucuccuuuuggaugugcucuaacgguucguuacagugcaggaucuguauuuga

SEQ ID NO: 126297 - RNA, 1701 nt, Artificial Sequence; identical to SEQ ID NO: 125786
  derived and/or modified sequence opt3 from hemagglutinin__InfluenzaA__ADD74648

SEQ ID NO: 126298 - RNA, 1701 nt, Artificial Sequence
  derived and/or modified sequence opt3 from hemagglutinin__InfluenzaA__ADD74658
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccggagggcgcaaucaacacuucccuccccuuccagaauauucacccuaucacaaucgguaaaugcccaaaguauguaaagucaaccaaacugcgccuugcuacugggcugagaaacgugcccaguauucagagcaggggauuguuuggcgccauagcgggcuucaucgaagggggauggacagguauggucgacggcugguacggguaucaucaccagaaugagcaaggauccggcuacgccgcagaucucaagucuacccagaacgcuauugacgagaucacgaauaaagugaacagcguuauagaaaagaugaauacccaguuuacagccguggguaaagaguucaaccaccuggaaaagcggauugagaauuuaaacaagaaagucgaugacggguuccuggauaucuggacuuacaaugcugaacuccuugugcuguuggagaacgagcgcacccuagacuaucaugauucaaauguaaagaaccuguacgaaaaaguucgaagucagcucaagaacaaugccaaagagaucggcaacggauguuuugaguucuaucacaagugcgacaauacauguauggaguccgugaagaacggcacuuacgauuauccuaaauacagcgaagaggcaaagcugaauagagaggaaauugacggggucaaacuugagucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 126299 - RNA, 1701 nt, Artificial Sequence; identical to SEQ ID NO: 126237
  derived and/or modified sequence opt3 from hemagglutinin__InfluenzaA__ADD74668

SEQ ID NO: 126300 - RNA, 1701 nt, Artificial Sequence; identical to SEQ ID NO: 126277
  derived and/or modified sequence opt3 from hemagglutinin__InfluenzaA__ADD74678

SEQ ID NO: 126301 - RNA, 1701 nt, Artificial Sequence; identical to SEQ ID NO: 126237
  derived and/or modified sequence opt3 from hemagglutinin__InfluenzaA__ADD74688

SEQ ID NO: 126302 - RNA, 1701 nt, Artificial Sequence
  derived and/or modified sequence opt3 from hemagglutinin__InfluenzaA__ADD74698
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaaaucagcucaagaacaaugcaaaggagaucggcaacggauguuuugaguucuaucacaaaugcgauaauacauguauggaaucagugaagaacggcacuuacgacuauccuaaauacagugaagaggccaagcugaauagagaagagauugauggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 126303 - RNA, 1701 nt, Artificial Sequence; identical to SEQ ID NO: 126237
  derived and/or modified sequence opt3 from hemagglutinin__InfluenzaA__ADD74708

SEQ ID NO: 126304 - RNA, 1701 nt, Artificial Sequence
  derived and/or modified sequence opt3 from hemagglutinin__InfluenzaA__ADD74728
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaagugucguguugguugugagccucggagcaaucuccuuuuggaugugcucuaaugguucgcugcagugccggauuuguaucuga

SEQ ID NO: 126305 - RNA, 1701 nt, Artificial Sequence
  derived and/or modified sequence opt3 from hemagglutinin__InfluenzaA__ADD74738
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaggaguuggagcuacauuguugagaccuccucuucggacaacggaacuugcuauccaggcgauuuuaucgacuacgaagaacuccgggagcagcugucaagcgugaguuccuucgaacgcuuugagauuuucccgaagacaucuagcuggcccaaucacgauuccaacaagggugucaccgccgcuuguccucaugcaggggccaaaucauuuuauaagaaucugaucuggcucgugaaaaagggaaacaguuacccaaaauuaagcaagucuuauauaaaugacaagggcaaagaaguacugguucuuuggggcauccaccaccccuccacgucagcugaucaacagagcuuguaccagaacgccgacgcguacguguucgucgggaccaguggauauucuaagaaauuuaagccugagauugcaauccgaccaaaagugcgugaucaggaggguagaaugaauuacuauuggacucugguggaacccggcgacaagauuacauucgaggccacugggaaccuagucguuccuagguacgcuuuugccauggaacggaacgcaggauccggcaucauaauuagcgauaccccagugcaugacugcaauacaaccugucaaacgccgaaaggugcuaucaacacuucgcuccccuuccagaauauucacccuaucacaaucgggaagugcccaaaguauguaaaaucuaccaagcugcgccuugccacuggacugagaaacgugcccuccauucagucaaggggcuuguuuggcgcgauagccggguucaucgagggagguuggacaggcauggucgacgggugguacggauaucaucaccagaaugaacaaggcagugguuacgcagcugaucucaaaagcacccagaacgccauugacaagaucacgaauaaagugaacuccguuauagagaagaugaauacccaguuuacagcuguggggaaggaguucaaccaccuggaaaaacggauugagaauuuaaacaagaaagucgaugacggcuuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggaaacggcuguuuugaguucuaucacaaaugcgacaauacauguauggagucagugaagaacgggacuuacgauuauccuaaauacagugaagaggccaagcugaauagagaagagauugacggagucaaacuugaguccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 126306 - RNA, 1701 nt, Artificial Sequence; identical to SEQ ID NO: 125849
  derived and/or modified sequence opt3 from hemagglutinin__InfluenzaA__ADD74748

SEQ ID NO: 126307 - RNA, 1701 nt, Artificial Sequence; identical to SEQ ID NO: 125849
  derived and/or modified sequence opt3 from hemagglutinin__InfluenzaA__ADD74758

SEQ ID NO: 126308 - RNA, 1701 nt, Artificial Sequence
  derived and/or modified sequence opt3 from hemagglutinin__InfluenzaA__ADD74768
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugagcuacuauuggacccugguggaacccggugacaagauuacauucgaggccacuggcaaucuagucguuccuagguacgcuuuugccauggaacggaacgcagggucgggaaucauaauuucugauaccccagugcaugacugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacaagaucacgaacaaagugaauagcguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucaaacguaaagaaucuguacgagaaaguucgaagucagcucaagaacaacgcaaaggagaucggcaauggauguuuugaguucuaucacaaaugcgacaacacauguauggaauccgugaagaauggcacuuacgauuauccuaaauacagcgaagaggccaagcugaacagagaagagauugacggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 126309 - RNA, 1701 nt, Artificial Sequence; identical to SEQ ID NO: 125849
  derived and/or modified sequence opt3 from hemagglutinin__InfluenzaA__ADD74778

SEQ ID NO: 126310 - RNA, 1701 nt, Artificial Sequence; identical to SEQ ID NO: 126237
  derived and/or modified sequence opt3 from hemagglutinin__InfluenzaA__ADD74788

SEQ ID NO: 126311 - RNA, 1701 nt, Artificial Sequence; identical to SEQ ID NO: 126237
  derived and/or modified sequence opt3 from hemagglutinin__InfluenzaA__ADD74798

SEQ ID NO: 126312 - RNA, 1701 nt, Artificial Sequence
  derived and/or modified sequence opt3 from hemagglutinin__InfluenzaA__ADD74808
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaagugggcaacggauguuuugaguucuaucacaagugcgacaauaccuguauggaauccgucaaaaacggcacauacgauuauccuaaguacagcgaggaagccaaacucaauagagaggagauugacggggugaagcuggaaucuacuaggaucuaucaaauucuugcuauauacucaaccgcggcaaguagccuggucuuggugguuucccucggagccaucucuuuuuggaugugcucgaacgguagccugcagugccggauuuguaucuga

SEQ ID NO: 126313 - RNA, 1701 nt, Artificial Sequence
  derived and/or modified sequence opt3 from hemagglutinin__InfluenzaA__ADD74818
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuaccauuggaccuugguggaacccggugacaagaucacauucgaggccacuggcaaccuggucguuccuagguaugcuuuugccauggaacggaacgcagggagcggaauaauuaucucggauaccccagugcacgacugcaauacaaccugucaaacgccgaaaggcgcuauuaacacuucucuacccuuccagaauauccauccuaucacaauugguaagugcccaaaguacguaaaauccaccaagcuccgccuggccacugggcuuagaaacgugcccucaauacagaguaggggacuguuuggcgcgaucgccggcuucauugaagggggauggacagguauggucgacggcugguauggguaccaccaccagaaugaacaaggaagcggcuaugcagcugauuugaaauccacccagaacgccaucgacgagauaacgaauaaggugaacucuguuauugagaaaaugaauacccaguuuacagcuguggguaaggaguucaaccaucucgagaagcggaucgaaaaucugaacaaaaaggucgaugacggguucuuagauaucuggacuuacaaugccgagcugcucgugcuucuggaaaacgagcgcaccuuggacuaccacgauagcaauguuaaaaaccuauaugagaagguacgaucacagcugaaaaacaaugcaaaggaaauuggcaacggauguuuugaguucuaccauaagugcgacaauacauguauggaaagugugaaaaacggcacuuaugauuacccuaaguauuccgaggaagccaaacucaauagagaggagaucgacggggucaagcuggaaagcaccaggauuuaccaaauacuugcuaucuauucuacaguggcgucaagucuggucuuggugguuagccucggagcaauuuccuuuuggaugugcucuaacgguucgcugcagugccggaucuguaucuga

SEQ ID NO: 126314 - RNA, 1701 nt, Artificial Sequence
  derived and/or modified sequence opt3 from hemagglutinin__InfluenzaA__ADD74838
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacguacacccuauuacaaucgguaagugcccaaaguaugugaaauccaccaagcugcgccuugccacugggcugagaaauguccccucaauccagaguaggggauuguuuggcgcgauugccggcuucauagaagggggauggacagguaugguggacggcugguacggguaucaucaccagaacgaacaaggaagcggcuacgcagcugaccucaaauccacccagaaugccaucgauaagauuacgaacaaaguuaauucugugaucgagaagaugaacacccaguuuacagcugucgguaaggaguucaaucaccuggaaaaacggauagagaacuuaaauaagaaaguggacgauggguuccuggacauuuggacuuacaacgccgaacuccuuguacuguuggagaaugaacgcacccuagauuaucaugacagcaacguuaagaaccuguacgagaaagugcgaucacagcucaagaauaacgcaaaggagaucggcaauggauguuuugaguucuaucacaaaugcgauaacacauguauggaaagugucaagaauggcacuuacgacuauccuaaauacuccgaagaggccaagcugaacagagaagagaucgauggggugaaacuugagagcaccaggauuuaucaaauccuggcuauuuacucuacagucgcgucaaguuuggugcucguugugagccugggagcaauauccuuuuggaugugcucuaaugguucguuacagugccggaucuguauuuga

SEQ ID NO: 126315 - RNA, 1701 nt, Artificial Sequence
  derived and/or modified sequence opt3 from hemagglutinin__InfluenzaA__ADD74848
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucaucgugagccugggagcaauuuccuuuuggaugugcucuaacgguucguuacagugccggaucuguaucuga

SEQ ID NO: 126316 - RNA, 1701 nt, Artificial Sequence
  derived and/or modified sequence opt3 from hemagglutinin__InfluenzaA__ADD74858
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcagggacgaaaaguuuuuauaagaaccugaucuggcucgugaaaaagggaaauagcuacccaaaauuaucuaaguccuauauaaacgauaagggcaaagaaguacugguucuuuggggcauccaccaccccucaacuagcgccgaccaacagaguuuguaccagaaugcugaugccuacguguucgucgggaccucucgcuauuccaagaaauuuaagccugagauugcgauccgaccaaaagugcgugaccaggagggaagaaugaacuacuauuggacacugguggaacccggugauaagauuacuuucgaggcaaccggcaaccuagucguuccuagguacgccuuugcuauggaacggaaugccgggagcggaaucauaauuucggacacaccagugcaugauugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgacggcugguacggguaucaucaccagaacgaacaaggaagcggcuacgccgcagaccucaaauccacgcagaaugcuauugauaagaucaccaacaaaguuaauucugugauagagaagaugaacacacaguuuacugccguggguaaggaguucaaucaccuggaaaaacggauugagaacuuaaauaagaaagucgacgauggguuccuggacaucuggaccuacaacgcugaacuccuugugcuguuggagaaugaacgcacacuagauuaucaugacagcaacguaaagaaccuguacgagaaaguucgaucacagcucaagaauaacgccaaggagaucggcaauggauguuuugaguucuaucacaaaugcgauaacacuuguauggaaagugugaagaauggcaccuacgacuauccuaaauacuccgaagaggcaaagcugaacagagaagagauugauggggucaaacuugagagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 126317 - RNA, 1701 nt, Artificial Sequence; identical to SEQ ID NO: 126237
  derived and/or modified sequence opt3 from hemagglutinin__InfluenzaA__ADD74868

SEQ ID NO: 126318 - RNA, 1701 nt, Artificial Sequence; identical to SEQ ID NO: 126237
  derived and/or modified sequence opt3 from hemagglutinin__InfluenzaA__ADD74878

SEQ ID NO: 126319 - RNA, 1701 nt, Artificial Sequence
  derived and/or modified sequence opt3 from hemagglutinin__InfluenzaA__ADD74888
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaaacagcuggcccaaucacgacuccaacaagggugucaccgccgcuuguccucaugcaggggccaaaucauuuuauaagaaucugaucuggcucgugaaaaagggaaacaguuacccaaaauuaagcaagucuuauauaaaugauaagggcaaagaaguacugguucuuuggggcauccaccaccccuccacgucagcugaccaacagagcuuguaccagaacgccgaugcguacguguucgucgggaccagucgcuauucuaagaaauuuaagccugagauugcaauccgaccaaaagugcgugaccaggagggaagaaugaauuacuauuggacucugguggaacccggugauaagauuacauucgaggccacuggcaaccuagucguuccuagguacgcuuuugccauggaacggaacgcaggguccggaaucauaauuagcgacaccccagugcaugacugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgauggcugguacggguaucaucaccagaaugaacaaggaaguggcuacgcagcugaccucaaaagcacccagaacgccauugaugagaucacgaauaaggugaacuccguuauagagaaaaugaauacccaguuuacagcuguggguaaggaguucaaccaccuggaaaagcggauugaaaauuuaaacaaaaaggucgacgauggguuccuggacaucuggacuuacaaugccgagcuccuugugcuguuggaaaacgagcgcacccuagauuaucaugacucuaauguaaagaaccuguacgagaagguucgaagccagcucaaaaacaaugcaaaggaaaucggcaacggauguuuugaguucuaucacaagugcgauaauacauguauggaaucagugaaaaacggcacuuacgacuauccuaaguacagugaggaagccaaacugaauagagaggagauugauggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 126320 - RNA, 1701 nt, Artificial Sequence
  derived and/or modified sequence opt3 from hemagglutinin__InfluenzaA__ADD74898
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuagcgccgaccaacagaguuuguaccagaaugcugaugccuacguguucgucgggaccucucgcuauuccaagaaauuuaagccugagauugcgauccgaccaaaagugcgugaccaggagggaagaaugaacuacuauuggacacugguggaacccggugauaagauuacuuucgaggcaaccggcaaccuagucguuccuagguacgccuuugcuauggaacggaaugccgggagcggaaucauaauuucggacacaccagugcaugauugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgacggcugguacggguaucaucaccagaacgaacaaggaagcggcuacgccgcagaccucaaauccacgcagaaugcuauugauaagaucaccaacaaaguuaauucugugauagagaagaugaacacacaguuuacugccguggguaaggaguucaaucaccuggaaaaacggauugagaacuuaaauaagaaagucgacgauggguuccuggacaucuggaccuacaacgcugaacuccuugugcuguuggagaaugaacgcacacuagauuaucaugacagcaacguaaagaaccuguacgagaaaguucgaucacagcucaagaauaacgccaaggagaucggcaauggauguuuugaguucuaucacaaaugcgauaacacuuguauggaaagugugaagaauggcaccuacgacuauccuaaauacuccgaagaggcaaagcugaacagagaagagauugauggggucaaacuugagagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 126321 - RNA, 1701 nt, Artificial Sequence
  derived and/or modified sequence opt3 from hemagglutinin__InfluenzaA__ADD74908
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuuaccauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 126322 - RNA, 1701 nt, Artificial Sequence; identical to SEQ ID NO: 126315
  derived and/or modified sequence opt3 from hemagglutinin__InfluenzaA__ADD74918

SEQ ID NO: 126323 - RNA, 1701 nt, Artificial Sequence; identical to SEQ ID NO: 126237
  derived and/or modified sequence opt3 from hemagglutinin__InfluenzaA__ADD74928

SEQ ID NO: 126324 - RNA, 1701 nt, Artificial Sequence; identical to SEQ ID NO: 126315
  derived and/or modified sequence opt3 from hemagglutinin__InfluenzaA__ADD74938

SEQ ID NO: 126325 - RNA, 1701 nt, Artificial Sequence
  derived and/or modified sequence opt3 from hemagglutinin__InfluenzaA__ADD74958
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaaaauaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucaacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgauggcugguacggguaucaucaccagaaugaacaaggaagcggcuacgcagcugaccucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaacguaaagaaucuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126326 - RNA, 1701 nt, Artificial Sequence; identical to SEQ ID NO: 125849
  derived and/or modified sequence opt3 from hemagglutinin__InfluenzaA__ADD74968

SEQ ID NO: 126327 - RNA, 1701 nt, Artificial Sequence
  derived and/or modified sequence opt3 from hemagglutinin__InfluenzaA__ADD74998
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacggggaagcggcuacgcagcugaucucaaauccacccaaaacgccauugacaagaucacgaauaaagugaacucuguuauagagaagaugaauacccaguuuacagcuguggguaaggaguucaaccaccuggaaaaacgcauugagaauuuaaacaagaaagucgaugacggguuccuggauaucuggacuuacaaugccgaacuccuugugcuguuggagaacgaacgaacccuagacuaucaugauagcaauguaaagaaccuguacgagaaaguuagaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagggaagagauugacggggucaaacuugagagcacccggaucuaucagauucuggcuauauacucuacaguggcgucaaguuugguccucgugguuagccugggagcaaucuccuuuuggaugugcucuaacgguucguuacaaugccguauuuguaucuga

SEQ ID NO: 126328 - RNA, 1701 nt, Artificial Sequence; identical to SEQ ID NO: 125849
  derived and/or modified sequence opt3 from hemagglutinin__InfluenzaA__ADD75008

SEQ ID NO: 126329 - RNA, 1701 nt, Artificial Sequence; identical to SEQ ID NO: 125849
  derived and/or modified sequence opt3 from hemagglutinin__InfluenzaA__ADD75018

SEQ ID NO: 126330 - RNA, 1701 nt, Artificial Sequence; identical to SEQ ID NO: 125849
  derived and/or modified sequence opt3 from hemagglutinin__InfluenzaA__ADD75028

SEQ ID NO: 126331 - RNA, 1701 nt, Artificial Sequence; identical to SEQ ID NO: 125786
  derived and/or modified sequence opt3 from hemagglutinin__InfluenzaA__ADD75058

SEQ ID NO: 126332 - RNA, 1701 nt, Artificial Sequence; identical to SEQ ID NO: 126105
  derived and/or modified sequence opt3 from hemagglutinin__InfluenzaA__ADD75088

SEQ ID NO: 126333 - RNA, 1701 nt, Artificial Sequence; identical to SEQ ID NO: 124685
  derived and/or modified sequence opt3 from hemagglutinin__InfluenzaA__ADD75098

SEQ ID NO: 126334 - RNA, 1701 nt, Artificial Sequence
  derived and/or modified sequence opt3 from hemagglutinin__InfluenzaA__ADD75108
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 126335 - RNA, 1701 nt, Artificial Sequence; identical to SEQ ID NO: 124685
  derived and/or modified sequence opt3 from hemagglutinin__InfluenzaA__ADD75118

SEQ ID NO: 126336 - RNA, 1701 nt, Artificial Sequence; identical to SEQ ID NO: 125132
  derived and/or modified sequence opt3 from hemagglutinin__InfluenzaA__ADD75128

SEQ ID NO: 126337 - RNA, 1701 nt, Artificial Sequence; identical to SEQ ID NO: 124685
  derived and/or modified sequence opt3 from hemagglutinin__InfluenzaA__ADD75138

SEQ ID NO: 126338 - RNA, 1701 nt, Artificial Sequence; identical to SEQ ID NO: 125849
  derived and/or modified sequence opt3 from hemagglutinin__InfluenzaA__ADD75148

SEQ ID NO: 126339 - RNA, 1701 nt, Artificial Sequence; identical to SEQ ID NO: 124685
  derived and/or modified sequence opt3 from hemagglutinin__InfluenzaA__ADD75158

SEQ ID NO: 126340 - RNA, 1701 nt, Artificial Sequence
  derived and/or modified sequence opt3 from hemagglutinin__InfluenzaA__ADD84494
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagaucagcuccuggcccaaucacgauccuaacaagggugucacagccgcuuguccacaugcaggggccaaaucauuuuauaagaaucugauauggcucgugaaaaagggaaacaguuaccccaaauuaagcaagucuuauaucaaugacaagggcaaagaaguacugguucuuuggggcauucaccacccuuccaccucagcugaucaacagagcuuguaccagaacgccgacgcguacguguucgucgggacgagucgcuauucuaagaaauuuaagccagagaucgcaauucgacccaaagugcgugaucaggagggaagaaugaauuacuauuggacucugguggaaccuggugacaagaucaccuucgaggccacaggcaaccuagucguuccaagguacgcuuuugccauggaacggaacgcaggguccggaauaauuaucagcgauacuccggugcauggcugcaauaccacaugucaaacccccaaaggugcuauuaacacgucgcucccuuuccagaauauccacccaaucacuauugggaagugccccaaguauguaaaaucuacaaagcugcgccuugccaccggacugagaaacgugccuuccauacagucaaggggcuuguuuggcgcgaucgccggguucauugagggagguuggacuggcauggucgacgggugguacggauaucaucaccagaaugaacaaggcagugguuacgcagcugaccucaaaagcacacagaacgccaucgaugagauaaccaauaaggugaacuccguuauugagaaaaugaauacgcaguuuaccgcuguggggaaggaguucaaccaccuggagaagcggaucgaaaauuuaaacaaaaaggucgacgauggcuuccuggacaucuggacauacaaugccgagcuccuugugcuguuggaaaacgagcgcacucuagauuaucaugacucuaauguaaagaaccuguacgagaagguucgaagccagcucaaaaacaaugcaaaggaaauuggaaacggcuguuuugaguucuaucacaagugcgauaauaccuguauggaaucagugaaaaacgggacauacgacuauccaaaguacagugaggaagccaaacugaauagagaggagaucgauggagucaaacuugaauccacuaggauuuaucaaauacuggcuaucuacagcaccguggcgucuucauugguccucgugguuagucugggugcaauuagcuuuuggaugugcuccaacggcucuuuacagugccggaucuguaucuga

SEQ ID NO: 126341 - RNA, 1701 nt, Artificial Sequence
  derived and/or modified sequence opt3 from hemagglutinin__InfluenzaA__ADD84495
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagaucagcuccuggcccaaucacgauccuaacaagggugucacagccgcuuguccacaugcaggggccaaaucauuuuauaagaaucugauauggcucgugaaaaagggaaacaguuaccccaaauuaagcaagucuuauaucaaugacaagggcaaagaaguacugguucuuuggggcauucaccacccuuccaccucagcugaucaacagagcuuguaccagaacgccgacgcguacguguucgucgggacgagucgcuauucuaagaaauuuaagccagagaucgcaauucgacccaaagugcgugaucaggagggaagaaugaauuacuauuggacucugguggaaccuggugacaagaucaccuucgaggccacaggcaaccuagucguuccaagguacgcuuuugccauggaacggaacgcaggguccggaauaauuaucagcgauacuccggugcaugacugcaauaccacaugucaaacccccaaaggcgcuauuaacacgucgcucccuuuccagaauauccacccaaucacuauugguaagugccccaaguauguaaaaucuacaaagcugcgccuugccaccgggcugagaaacgugccuuccauacagucaaggggauuguuuggcgcgaucgccggcuucauugaagggggauggacugguauggucgacggcugguacggguaucaucaccagaaugaacaaggaaguggcuacgcagcugaucucaaaagcacacagaacgccaucgacgagauaaccaauaaggugaacuccguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauucuaauguaaagaaccuguacgagaagguucgaagccagcucaaaaacaaugcaaaggaaauuggcaacggauguuuugaguucuaucacaagugcgacaauaccuguauggaaucagugaaaaacggcacauacgauuauccaaaguacagugaggaagccaaacugaauagagaggagaucgacggggucaaacuugaauccacuaggauuuaucaaauacuggcuaucuacagcaccguggcgucuucauugguccucgugguuagucugggagcaauuagcuuuuggaugugcuccaacgguucuuuacagugccggaucuguaucuga

SEQ ID NO: 126342 - RNA, 1701 nt, Artificial Sequence
  derived and/or modified sequence opt3 from hemagglutinin__InfluenzaA__ADD84496
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagaucagcuccuggcccaaucacgauccuaacaagggugucacagccgcuuguccacaugcaggggccaaaucauuuuauaagaaucugauauggcucgugaaaaagggaaacaguuaccccaaauuaagcaagucuuauaucaaugacaagggcaaagaaguacugguucuuuggggcauucaccacccuuccaccucagcugaucaacagagcuuguaccagaacgccgacgcguacguguucgucgggaguucucgcuauuccaagaaauuuaagccagagaucgcaauucgacccaaagugcgugaucaggagggaagaaugaauuacuauuggacgcugguggaaccuggugacaagaucacuuucgaggccaccggcaaccuagucguuccaagguacgcuuuugccauggaacggaacgcagggagcggaauaauuaucucggauacaccggugcaugacugcaauacuaccugucaaacacccaaaggcgcuauuaacaccucucucccuuuccagaauauccacccaaucacgauugguaagugccccaaguauguaaaauccacuaagcugcgccuugccacagggcugagaaacgugccuucaauacagaguaggggauuguuuggcgcgaucgccggcuucauugaagggggauggaccgguauggucgacggcugguacggguaucaucaccagaaugaacaaggaagcggcuacgcagcugaucucaaauccacucagaacgccaucgacgagauaacaaauaaggugaacucuguuauugagaaaaugaauacccaguuuacggcuguggguaaggaguucaaccaccuggaaaagcggaucgaaaauuuaaacaaaaaggucgaugacggguuccuggauaucuggaccuacaaugccgagcuccuugugcuguuggaaaacgagcgcacacuagacuaucaugauagcaauguaaagaaccuguacgagaagguucgaucacagcucaaaaacaaugcaaaggaaauuggcaacggauguuuugaguucuaucacaagugcgacaauacuuguauggaaagugugaaaaacggcaccuacgauuauccaaaguacuccgaggaagccaaacugaauagagaggagaucgacggggucaaacuugaaagcacaaggauuuaucaaauacuggcuaucuacucuacuguggcgucaaguuugguccucgugguuagccugggagcaauuuccuuuuggaugugcucuaacgguucguuacagugccggaucuguaucuga

SEQ ID NO: 126343 - RNA, 1701 nt, Artificial Sequence; identical to SEQ ID NO: 126341
  derived and/or modified sequence opt3 from hemagglutinin__InfluenzaA__ADD84497

SEQ ID NO: 126344 - RNA, 1701 nt, Artificial Sequence
  derived and/or modified sequence opt3 from hemagglutinin__InfluenzaA__ADD84498
augaaggccauccuggugguccuccuuuacaccuucgcuacagcaaacgccgacacucugugcauuggcuaucacgcgaauaacagcacggauaccguugugacaguauuggagaaaaaugugacugucacccauuccgugaacuuacuggaagacaagcacaaugggaaacuauguaagcucagaggaguugcuccccugcaucuugguaaaugcaacauagccggcuggauccuggggaauccugagugugaaucuuugucaacagcaaguagcugguccuacauuguggagaccucuucgucagauaacggaacuugcuauccaggcgacuuuaucgauuacgaggagcucagggagcagcugagcagugucuccucuuucgaacgguuugagauuuucccgaagaucagcuccuggcccaaucacgacccuaacaagggugugacagccgcuuguccacaugcaggggccaaaucauuuuauaagaaucugauauggcucguaaagaagggaaacaguuaccccaaauuaagcaagucuuauaucaaugauaagggcaaagaaguucuggugcuuuggggcauucaccacccuuccaccucagcugaccaacagagcuuguaccagaacgccgaugcguacgucuucguggggaguucucgcuauuccaagaaauuuaagccagagaucgcaauucgacccaaagugcgugaccaggagggaagaaugaauuacuauuggacgcuggucgaaccuggugauaagaucacuuucgaggccaccggcaaccuaguugugccaagguacgcuuuugccauggaacggaacgcagggagcggaauaauuaucucggacacaccgguacaugauugcaauacuaccugucaaacacccaaaggcgcuauuaacaccucucucccuuuccagaauauccacccaaucacgauugguaagugccccaaguaugugaaauccacuaagcugcgccuugccacagggcugagaaacgucccuucaauacagaguaggggauuguuuggcgcgaucgccggcuucauugaagggggauggaccgguaugguggacggcugguacggguaucaucaccagaaugaacaaggaagcggcuacgcagcugaccucaaauccacucagaacgccaucgaugagauaacaaauaagguuaacucugugauugagaaaaugaauacccaguuuacggcugucgguaaggaguucaaccaccuggaaaagcggaucgaaaauuuaaacaaaaagguggacgauggguuccuggacaucuggaccuacaaugccgagcuccuuguacuguuggaaaacgagcgcacacuagauuaucaugacagcaauguuaaaaaccuguacgagaaggugcgaucacagcucaaaaacaaugcaaaggaaauuggcaacggauguuuugaguucuaucacaagugcgauaauacuuguauggaaagugucaaaaacggcaccuacgacuauccaaaguacuccgaggaagccaaacugaauagagaggagaucgauggggugaaacuugaaagcacaaggauuuaucaaauacuggcuaucuacucuacugucgcgucaaguuuggugcucguugugagccugggagcaauuuccuuuuggaugugcucuaacgguucguuacagugccggaucuguaucuga

SEQ ID NO: 126345 - RNA, 1701 nt, Artificial Sequence; identical to SEQ ID NO: 126341
  derived and/or modified sequence opt3 from hemagglutinin__InfluenzaA__ADD84499

SEQ ID NO: 126346 - RNA, 1701 nt, Artificial Sequence
  derived and/or modified sequence opt3 from hemagglutinin__InfluenzaA__ADD92535
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugaacagggaagcggcuacgcagcugaucucaaauccacccaaaacgccauugacgagaucacgaaucgcgugaacucuguuauagagaagaugaauacccaguuuacagcuguggguaaagaguucaaccaccuggaaaagcgaauugaaaauuuaaacaagaaagucgaugggggcuuccuggacaucuggacuuacaaugccgagcuccuugugcuguuggaaaacgagagaacccuagauuaucaugacagcaauguaaagaaccuguacgagaaaguuaggucacagcucaagaacaaugcaaaagaaaucggaaacggcuguuuugaguucuaucacaagugcgauaauacauguauggaaagugugaagaacgggacuuacgacuauccuaaauacuccgaggaagccaagcugaaucgggaggagauugauggagucaaacuugaaagcacccguaucuaucagauucuggcuauauacucuacaguggcgucaaguuugguccucgugguuagccugggugcaaucuccuuuuggaugugcucuaacggcucguuacaaugccgcauuuguaucuga

SEQ ID NO: 126347 - RNA, 1701 nt, Artificial Sequence; identical to SEQ ID NO: 126273
  derived and/or modified sequence opt3 from hemagglutinin__InfluenzaA__ADD96766

SEQ ID NO: 126348 - RNA, 1701 nt, Artificial Sequence; identical to SEQ ID NO: 124865
  derived and/or modified sequence opt3 from hemagglutinin__InfluenzaA__ADD96776

SEQ ID NO: 126349 - RNA, 1701 nt, Artificial Sequence; identical to SEQ ID NO: 124865
  derived and/or modified sequence opt3 from hemagglutinin__InfluenzaA__ADD96786

SEQ ID NO: 126350 - RNA, 1701 nt, Artificial Sequence; identical to SEQ ID NO: 126170
  derived and/or modified sequence opt3 from hemagglutinin__InfluenzaA__ADD96796

SEQ ID NO: 126351 - RNA, 1701 nt, Artificial Sequence
  derived and/or modified sequence opt3 from hemagglutinin__InfluenzaA__ADD96806
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucgacuacgaggagcugagggagcagcugagcaguguguccucuuuugaacgguucgagauuuuuccgaagacaagcuccuggcccaaucacgauucaaacaagggugucaccgccgcuuguccucaugcaggggccaaaaguuucuauaagaaucucaucugguuagugaaaaagggaaacagcuacccaaaacugucuaaguccuauauaaaugacaagggcaaagaaguacuuguuuuguggggcauccaccaccccucaacgagcgcugaucaacagagucuguaccagaacgccgacgcguacguguuugucgggacuucucgcuauuccaagaaauucaagccugagauugcaauccgaccaaaagugcgugaucaggagggaagaaugaauuacuauuggacccuaguggaacccggugacaagauuacauuugaggccacuggcaaccucgucguuccuagguacgcuuucgccauggaacggaacgcagggagcggaaucauaauuucggauaccccagugcaugacugcaauacaaccugucaaacgccgaaaggcgcuaucaacacuucucugcccuuucagaauauucacccuaucacaaucgguaagugcccaaaguauguaaaauccaccaaacuucgccuggccacuggguugagaaacgugcccucaauucagaguaggggacucuucggcgcgauagccggcuuuaucgaagggggauggacagguauggucgacggcugguacggguaucaucaccagaaugaacaaggaagcggcuacgcagcugaucugaaauccacccagaacgccauugacgagaucacgaauaaggugaacucuguuauagagaaaaugaauacccaguucacagcuguggguaaggaauuuaaccacuuagagaagcggauugaaaaucugaacaaaaaggucgaugacggguuccucgauaucuggacuuacaaugccgagcuucugguguugcuagaaaacgagcgcacccuggacuaucaugauagcaauguaaagaaccucuacgagaagguucgaucacagcugaaaaacaaugcaaaggaaaucggcaacggauguuucgaguuuuaucacaagugcgacaauacauguauggaaagugugaaaaacggcacuuacgauuauccuaaguacuccgaggaagccaaacuuaauagagaggagauugacggggucaagcuggaaagcaccaggaucuaucaaauuuuggcuauauacucuacaguggcgucaagucucguccuggugguuagcuuaggagcaaucuccuucuggaugugcucuaacgguucgcugcagugccggauuuguaucuga

SEQ ID NO: 126352 - RNA, 1701 nt, Artificial Sequence; identical to SEQ ID NO: 125849
  derived and/or modified sequence opt3 from hemagglutinin__InfluenzaA__ADD96816

SEQ ID NO: 126353 - RNA, 1701 nt, Artificial Sequence
  derived and/or modified sequence opt3 from hemagglutinin__InfluenzaA__ADD96826
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugauggaucaggagggacguaugaauuacuauuggacccugguggaacccggugacaagauuacauucgaggccacuggcaaccuagucguuccuagauacgcuuuugccauggaaaggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuugcugccguggguaaggaguucaaccaccuggaaaagaggauugaaaauuuaaacaaaaaggucgaugacggguuccuggauaucuggacauacaaugcagagcuccuugugcuguuggaaaacgagcggacucuagacuaucaugauagcaauguaaagaaccuguacgagaagguucgcucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaaucgagaggagauugacggggucaaacuugaaagcacuagaaucuaucaaauucuggcgauauacucuaccguggcaucaaguuugguccucgugguuagccugggagccaucuccuuuuggaugugcucuaacgguucguuacagugcaggauuuguaucuga

SEQ ID NO: 126354 - RNA, 1701 nt, Artificial Sequence; identical to SEQ ID NO: 124685
  derived and/or modified sequence opt3 from hemagglutinin__InfluenzaA__ADD96836

SEQ ID NO: 126355 - RNA, 1701 nt, Artificial Sequence; identical to SEQ ID NO: 124685
  derived and/or modified sequence opt3 from hemagglutinin__InfluenzaA__ADD96846

SEQ ID NO: 126356 - RNA, 1701 nt, Artificial Sequence; identical to SEQ ID NO: 126237
  derived and/or modified sequence opt3 from hemagglutinin__InfluenzaA__ADD96856

SEQ ID NO: 126357 - RNA, 1701 nt, Artificial Sequence; identical to SEQ ID NO: 125038
  derived and/or modified sequence opt3 from hemagglutinin__InfluenzaA__ADD96886

SEQ ID NO: 126358 - RNA, 1701 nt, Artificial Sequence; identical to SEQ ID NO: 126312
  derived and/or modified sequence opt3 from hemagglutinin__InfluenzaA__ADD96896

SEQ ID NO: 126359 - RNA, 1701 nt, Artificial Sequence; identical to SEQ ID NO: 125849
  derived and/or modified sequence opt3 from hemagglutinin__InfluenzaA__ADD96906

SEQ ID NO: 126360 - RNA, 1701 nt, Artificial Sequence; identical to SEQ ID NO: 125849
  derived and/or modified sequence opt3 from hemagglutinin__InfluenzaA__ADD96916

SEQ ID NO: 126361 - RNA, 1701 nt, Artificial Sequence; identical to SEQ ID NO: 125849
  derived and/or modified sequence opt3 from hemagglutinin__InfluenzaA__ADD96926

SEQ ID NO: 126362 - RNA, 1701 nt, Artificial Sequence
  derived and/or modified sequence opt3 from hemagglutinin__InfluenzaA__ADD96936
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcugaucaaaaagggaaacagcuacccaaaacucucuaaguccuauauuaaugacaagggcaaagaaguguuaguacuguggggcauccaccaccccucaacgagcgcugaucaacagagucuuuaccagaacgccgacgcguacguuuucguggggacuucucgcuauuccaagaaauuuaagccugagauugcaauccgaccaaaaguccgugaucaggagggaagaaugaauuacuauuggaccuugguggaacccggugacaagauaacauucgaggccacuggcaaccugguggucccuagguacgcuuuugccauggaacggaacgcagggagcggaauuaucauuucggauaccccaguucaugacugcaauacaaccugucaaacgccgaaaggcgcuaucaacacuucucuacccuuccagaauauccacccuauuacaauagguaagugcccaaaguaugugaaauccaccaagcuccgccuggccacugggcuuagaaacguacccucaauccagaguaggggacuguuuggcgcgauugccggcuucaucgaagggggauggacagguaugguggacggcugguacggguaucaucaccagaaugaacaaggaagcggcuacgcagcugauuugaaauccacccagaacgccauagacgagauuacgaauaaggucaacucugugaucgagaaaaugaauacccaguuuacagcuguugguaaggaguucaaccaccucgagaagcggaucgaaaaucugaacaaaaagguggaugacggguucuuagauauuuggacuuacaaugccgagcugcucguccuucuggaaaacgagcgcaccuuggacuaucaugauagcaaugugaaaaaccuauacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacucaauagagaggagauugacggggugaagcuggaaagcaccaggauauaucaaauccuugcuauuuacucuacagucgcgucaagucugguguuggucgugagccucggagcaaucuccuuuuggaugugcucuaacgguucgcugcagugccggaucuguauuuga

SEQ ID NO: 126363 - RNA, 1701 nt, Artificial Sequence
  derived and/or modified sequence opt3 from hemagglutinin__InfluenzaA__ADD96946
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucaagcgguuugaaauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucggugaaugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126364 - RNA, 1701 nt, Artificial Sequence
  derived and/or modified sequence opt3 from hemagglutinin__InfluenzaA__ADD96956
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccuggugaagcccggugauaaaauuacauucgaggccacuggcaaccuagucguuccuagguacgcuuuugccauggaacggaacgcagggagcggaaucauaauuucggacaccccagugcaugauugcaauacaaccugucaaacgccgaagggcgcuaucaacacuucucuccccuuccagaauauucacuccaucacaaucgguaagugcccuaaauauguaaagucaaccaaacugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaccucaagucuacccagaacgccauugaugagaucacgaauaaagugaacagcguuauagagaagaugaauacccaguuuacagcuguggguaaggaguucaaccaccuggaaaaacggauugaaaauuuaaacaagaaagucgacgauggguuccuggacaucuggacuuacaaugccgagcuccuugugcuguuggaaaacgagcgcacccuagauuaucaugacucaaauguaaagaaccuguacgagaaaguucgaagucagcucaagaacaaugcaaaggaaaucggcaacggauguuuugaguucuaucacaaaugcgauaauacauguauggaauccgugaagaacggcacuuacgacuaucccaaauacagcgaggaagccaagcugaauagagaggagauugauggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 126365 - RNA, 1701 nt, Artificial Sequence; identical to SEQ ID NO: 124685
  derived and/or modified sequence opt3 from hemagglutinin__InfluenzaA__ADD96976

SEQ ID NO: 126366 - RNA, 1701 nt, Artificial Sequence; identical to SEQ ID NO: 124685
  derived and/or modified sequence opt3 from hemagglutinin__InfluenzaA__ADD96986

SEQ ID NO: 126367 - RNA, 1701 nt, Artificial Sequence
  derived and/or modified sequence opt3 from hemagglutinin__InfluenzaA__ADD97035
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgcauggccacugggcuuagaaacgugcccucaauucagaguaggggacuguuuggcgcgauagccggcuucaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguuuacagcuguggguaaggaguucaaccaccucgaaaagcggauugaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacucaauagagaggagauugacggggucaagcuggaaagcaccaggaucuaucaaauucuugcuauauacucuacaguggcgucaagucuggucuuggugguuagccucggagcaaucuccuuuuggaugugcucuaacgguucgcugcagugccggauuuguaucuga

SEQ ID NO: 126368 - RNA, 1701 nt, Artificial Sequence
  derived and/or modified sequence opt3 from hemagglutinin__InfluenzaA__ADD97045
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuacagacuacgaggagcucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 126369 - RNA, 1701 nt, Artificial Sequence; identical to SEQ ID NO: 126368
  derived and/or modified sequence opt3 from hemagglutinin__InfluenzaA__ADD97055

SEQ ID NO: 126370 - RNA, 1701 nt, Artificial Sequence; identical to SEQ ID NO: 126368
  derived and/or modified sequence opt3 from hemagglutinin__InfluenzaA__ADD97123

SEQ ID NO: 126371 - RNA, 1701 nt, Artificial Sequence
  derived and/or modified sequence opt3 from hemagglutinin__InfluenzaA__ADD97161
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaaaagcuacccaaaguuaucuaaguccuauauaaacgacaaaggcaagaaaguacugguucuuuggggcauccaccaccccucaacgagcgcugaucaacagaguuuguaccagaaugccgacgcguacguguucgucgggacuucucgcuauuccaagaaauuuaagccugaaauugcaauccgaccaaaagugcgugaucaggagggaagaaugaacuacuauuggacccugguggagcccggugacaagauuacauucgaagccacuggcaaucuagucguuccuagguacgcuuuugccauggagcggaacgcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaucucaaauccacccagaaugccauugacgaaaucacgaacaagguaaauucuguuauagagaagaugaacacccaguuuacagcuguggguaaagaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaucuguacgagaagguucgaucacagcucaagaacaacgcaaaagagaucggcaauggauguuuugaguucuaucacaagugcgacaacacauguauggagagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126372 - RNA, 1701 nt, Artificial Sequence
  derived and/or modified sequence opt3 from hemagglutinin__InfluenzaA__ADD97171
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaguguccuuuuggaugugcucuaacgguucguuacagugccggaucuguauuuga

SEQ ID NO: 126373 - RNA, 1701 nt, Artificial Sequence; identical to SEQ ID NO: 124685
  derived and/or modified sequence opt3 from hemagglutinin__InfluenzaA__ADD97181

SEQ ID NO: 126374 - RNA, 1701 nt, Artificial Sequence; identical to SEQ ID NO: 124685
  derived and/or modified sequence opt3 from hemagglutinin__InfluenzaA__ADD97201

SEQ ID NO: 126375 - RNA, 1701 nt, Artificial Sequence; identical to SEQ ID NO: 126368
  derived and/or modified sequence opt3 from hemagglutinin__InfluenzaA__ADD97211

SEQ ID NO: 126376 - RNA, 1701 nt, Artificial Sequence; identical to SEQ ID NO: 124685
  derived and/or modified sequence opt3 from hemagglutinin__InfluenzaA__ADD97231

SEQ ID NO: 126377 - RNA, 1701 nt, Artificial Sequence
  derived and/or modified sequence opt3 from hemagglutinin__InfluenzaA__ADD97241
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuacagacuacgaggagcucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcauaauugcaacaccacgugucaaacuccgaaaggcgcuauuaauacaucucuccccuuccagaacauccacccuauuaccaucgguaagugcccaaaguauguaaaauccacuaagcugcgccuugccacagggcugagaaaugugcccucaauccagaguaggggauuguuuggcgcgauugccggcuucauagaagggggauggaccgguauggucgacggcugguacggguaucaucaccagaacgaacaaggaagcggcuacgcagcugaccucaaauccacgcagaaugccaucgaugagauuaccaacaagguaaauucuguuaucgagaaaaugaacacacaguuuacugcuguggguaaggaguucaaucaccuggaaaagcggauagaaaacuuaaauaaaaaggucgacgauggguuccuggacauuuggaccuacaacgccgagcuccuugugcuguuggaaaaugagcgcacacuagauuaucaugacagcaacgugaaaaaccuguacgagaagguucgaucacagcucaaaaauaacgcaaaggaaaucggcaauggauguuuugaguucuaucacaagugcgauaacacuuguauggaaagugugaaaaauggcaccuacgacuauccuaaguacuccgaggaagccaaacugaacagagaggagaucgauggggucaaacuugaaagcacaaggauuuaucaaauccuggcuauuuacucuaccguggcgucaaguuugguccucgugguuagccugggagcaauauccuuuuggaugugcucuaaugguucguuacagugccggaucuguauuuga

SEQ ID NO: 126378 - RNA, 1701 nt, Artificial Sequence; identical to SEQ ID NO: 126368
  derived and/or modified sequence opt3 from hemagglutinin__InfluenzaA__ADD97251

SEQ ID NO: 126379 - RNA, 1701 nt, Artificial Sequence; identical to SEQ ID NO: 124685
  derived and/or modified sequence opt3 from hemagglutinin__InfluenzaA__ADD97261

SEQ ID NO: 126380 - RNA, 1701 nt, Artificial Sequence
  derived and/or modified sequence opt3 from hemagglutinin__InfluenzaA__ADD97271
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacauucccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 126381 - RNA, 1701 nt, Artificial Sequence; identical to SEQ ID NO: 126372
  derived and/or modified sequence opt3 from hemagglutinin__InfluenzaA__ADD97281

SEQ ID NO: 126382 - RNA, 1701 nt, Artificial Sequence; identical to SEQ ID NO: 124685
  derived and/or modified sequence opt3 from hemagglutinin__InfluenzaA__ADD97291

SEQ ID NO: 126383 - RNA, 1701 nt, Artificial Sequence
  derived and/or modified sequence opt3 from hemagglutinin__InfluenzaA__ADD97311
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgauugcugaucaacagagcuuguaccagaacgccgacgcguacguauucguugggaccagucgcuauucuaagaaauuuaagccugagaucgcaauacgaccaaaagugcgugaucaggagggaagaaugaaguacuauuggacucuggucgaacccggugacaaaauuacauucgaggccacuggcaaucuaguggugccuagguacgcuuuugccauggaacggaacgcaggguccggaaucauuaucagcgauaccccaguccauaacugcaauacaaccugucaaacgucgaagggcgcuaucaacacuucucucccguuccagaauauucaccccauaacaaucgguaagugcccuaaauauguuaaguccaccaaacugcgccuugccacugggcugagaaacgugccaucaauucagaguaggggauuguuuggcgcgaucgccggcuucauagaagggggauggacagguaugguagacggcugguacggguaucaucaccagaaugaacaaggaagcggcuacgcagcugaccucaaguccacccagaacgccauugaugagaucacgaauaaagugaacucugucaucgagaagaugaauacccaguuuacagcuguggguaaggaguucaaccaccuggaaaaacggauugaaaauuuaaacaagaaaguugacgauggguuccuggacaucuggacuuacaaugccgagcuccuugugcuguuggaaaacgagcgcacccuagauuaucaugacagcaaugucaagaaccuguacgagaaagugcgaucacagcucaagaacaaugcaaaggaaauuggcaacggauguuuugaguucuaucacaaaugcgauaauacauguauggaaaguguaaagaacggcacuuacgacuaucccaaauacuccgaggaagccaagcugaauagagaggagauagaugggguuaaacuugaaagcaccaggaucuaucaaauucuggcuaucuacucuacaguggcgucaaguuugguccucguggucagccugggagcaaucuccuuuuggaugugcucuaacgguucguuacagugccggauuuguauauga

SEQ ID NO: 126384 - RNA, 1701 nt, Artificial Sequence; identical to SEQ ID NO: 126368
  derived and/or modified sequence opt3 from hemagglutinin__InfluenzaA__ADD97321

SEQ ID NO: 126385 - RNA, 1701 nt, Artificial Sequence; identical to SEQ ID NO: 125849
  derived and/or modified sequence opt3 from hemagglutinin__InfluenzaA__ADD97331

SEQ ID NO: 126386 - RNA, 1701 nt, Artificial Sequence
  derived and/or modified sequence opt3 from hemagglutinin__InfluenzaA__ADD97341
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcacugaucaacagaguuuguaccagaacgccgacgcuuacgucuucguggggaccucucgcuauuccaagaaauuuaagccugagauugccauccgaccaaaagugcgugaucaggagggaagaaugaauuacuauuggacacuggucgaacccggugacaagauuacuuucgaggcgaccggcaaccuaguugugccuagguacgcauuugccauggaacggaacgcugggagcggaaucauaauuucggauacaccaguacaugacugcaauaccacgugucaaacuccgaaaggcgccaucaacacaucucuccccuuccagaauauucacccuaucaccaucgguaagugcccaaaguaugugaaauccacuaagcugcgccuugcaacagggcugagaaacauucccucaauacagaguaggggauuguuuggcgcuaucgccggcuucauugaagggggauggaccgguauggucgacggcugguacggguaucaucaccagaaugaacaaggaagcggcuacgcggccgaucucaaauccacgcagaacgcaaucgacgagauaaccaauaaggugaacucuguuauugagaaaaugaauacacaguuuacugcuguggguaaggaguucaaccaccuggaaaagcggaucgaaaauuuaaacaaaaaggucgaugacggguuccuggauaucuggaccuacaaugccgagcuccuugugcuguuggaaaacgagcgcacacuagacuaucaugauagcaauguuaaaaaccuguacgagaagguacgaucacagcucaaaaacaaugcuaaggaaauuggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauacuggcaaucuacucuaccguggccucaaguuugguccucgugguuagccugggagcuauuuccuuuuggaugugcucuaacgguucguuacagugccggaucuguaucuga

SEQ ID NO: 126387 - RNA, 1701 nt, Artificial Sequence; identical to SEQ ID NO: 125849
  derived and/or modified sequence opt3 from hemagglutinin__InfluenzaA__ADD97351

SEQ ID NO: 126388 - RNA, 1701 nt, Artificial Sequence; identical to SEQ ID NO: 125849
  derived and/or modified sequence opt3 from hemagglutinin__InfluenzaA__ADD97361

SEQ ID NO: 126389 - RNA, 1701 nt, Artificial Sequence
  derived and/or modified sequence opt3 from hemagglutinin__InfluenzaA__ADD97371
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggguguguauuuga

SEQ ID NO: 126390 - RNA, 1701 nt, Artificial Sequence; identical to SEQ ID NO: 125849
  derived and/or modified sequence opt3 from hemagglutinin__InfluenzaA__ADD97381

SEQ ID NO: 126391 - RNA, 1701 nt, Artificial Sequence; identical to SEQ ID NO: 124685
  derived and/or modified sequence opt3 from hemagglutinin__InfluenzaA__ADD97391

SEQ ID NO: 126392 - RNA, 1701 nt, Artificial Sequence; identical to SEQ ID NO: 125849
  derived and/or modified sequence opt3 from hemagglutinin__InfluenzaA__ADD97411

SEQ ID NO: 126393 - RNA, 1701 nt, Artificial Sequence; identical to SEQ ID NO: 125849
  derived and/or modified sequence opt3 from hemagglutinin__InfluenzaA__ADD97421

SEQ ID NO: 126394 - RNA, 1701 nt, Artificial Sequence; identical to SEQ ID NO: 124685
  derived and/or modified sequence opt3 from hemagglutinin__InfluenzaA__ADD97431

SEQ ID NO: 126395 - RNA, 1701 nt, Artificial Sequence
  derived and/or modified sequence opt3 from hemagglutinin__InfluenzaA__ADD97441
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggaacggaacgcagggagcggaauuaucauuucggauaccccaguccaugacugcaauacaaccugucaaacgccgaaaggcgcuaucaacacuucucuccccuuccagaauauccacccuauuacaauagguaagugcccaaaguauguuaaauccaccaagcugcgccuugccacugggcugagaaacgugcccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 126396 - RNA, 1701 nt, Artificial Sequence; identical to SEQ ID NO: 126389
  derived and/or modified sequence opt3 from hemagglutinin__InfluenzaA__ADD97451

SEQ ID NO: 126397 - RNA, 1701 nt, Artificial Sequence; identical to SEQ ID NO: 126389
  derived and/or modified sequence opt3 from hemagglutinin__InfluenzaA__ADD97461

SEQ ID NO: 126398 - RNA, 1701 nt, Artificial Sequence; identical to SEQ ID NO: 126237
  derived and/or modified sequence opt3 from hemagglutinin__InfluenzaA__ADD97471

SEQ ID NO: 126399 - RNA, 1701 nt, Artificial Sequence; identical to SEQ ID NO: 126237
  derived and/or modified sequence opt3 from hemagglutinin__InfluenzaA__ADD97481

SEQ ID NO: 126400 - RNA, 1701 nt, Artificial Sequence
  derived and/or modified sequence opt3 from hemagglutinin__InfluenzaA__ADD97491
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagaggcuccccugcaucuugguaaaugcaacauagccggcuggauccuggggaauccugaaugugagucuuugucaacagcaaguagcugguccuacauuguggaaaccucuucgucagacaacggaacuugcuauccaggcgauuuuaucaauuacgaggagcucagggaacagcugagcaguguuuccucuuucgagcgguuugaaauuuucccgaagacaagcuccuggcccaaccacgacucaaauaagggugugaccgccgcuuguccucaugcaggggccaaaaguuuuuauaagaaccugaucuggcucgucaaaaagggaaauagcuacccaaaauuaucuaaguccuauauaaacgauaagggcaaagaggugcugguacuuuggggcauccaccaccccucaacgagcgcugaccaacagaguuuguaccagaaugccgaugcguacguuuucguggggacuucucgcuauuccaagaaauuuaagccugagauugcaauccgaccaaaaguccgugaccaggaaggaagaaugaacuacuauuggacccugguggagcccggugauaagauuacauucgaagccacuggcaaccuaguggucccuagguacgcuuuugccauggagcggaaugcagggagcggaaucauaauuucggacaccccaguucaugauugcaacacaaccugucaaacgccgaaaggcgcuaucaauacuucucuccccuuccagaacauucacccuaucacaaucgguaagugcccaaaguaugugaaauccaccaagcugcgccuugccacugggcugagaaauguacccucaauucagaguaggggauuguuuggcgcgauagccggcuucaucgaagggggauggacagguaugguggacggcugguacggguaucaucaccagaacgagcaaggaagcggcuacgcagcugaccucaaauccacccagaaugccauugauaagaucacgaacaaagucaauucugugauagagaagaugaacacccaguuuacagcuguugguaaggaguucaaucaccuggaaaaacggauugaaaacuuaaauaagaaaguggacgauggguuccuggacaucuggacuuacaacgccgagcuccuuguccuguuggaaaaugagcgcacccuagauuaucaugacagcaacgugaagaaccuguacgagaaaguacgaucacagcucaagaauaacgcaaaggaaaucggcaauggauguuuugaguucuaucacaaaugcgauaacacauguauggaaaguguuaagaauggcacuuacgacuauccuaaauacuccgaggaagccaagcugaacagagaggagauugauggggugaaacuugaaagcaccaggaucuaucaaauucuggcuauauacucuacagucgcgucaaguuuggugcucgucgugagccugggagcaaucuccuuuuggaugugcucuaaugguucguuacagugccggauuuguaucuga

SEQ ID NO: 126401 - RNA, 1701 nt, Artificial Sequence; identical to SEQ ID NO: 126400
  derived and/or modified sequence opt3 from hemagglutinin__InfluenzaA__ADD97501

SEQ ID NO: 126402 - RNA, 1701 nt, Artificial Sequence; identical to SEQ ID NO: 125038
  derived and/or modified sequence opt3 from hemagglutinin__InfluenzaA__ADD97511

SEQ ID NO: 126403 - RNA, 1701 nt, Artificial Sequence
  derived and/or modified sequence opt3 from hemagglutinin__InfluenzaA__ADD97531
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgauugcugaucaacagagcuuguaccagaacgccgacgcguacguauucguugggaccagucgcuauucuaagaaauuuaagccugagaucgcaauacgaccaaaagugcgugaucaggagggaagaaugaaguacuauuggacucuggucgaacccggugacaaaauuacauucgaggccacuggcaaucuaguggugccuagguacgcuuuugccauggaacggaacgcaggguccggaaucauuaucagcgauaccccaguccauaacugcaauacaaccugucaaacgccgaagggcgcuaucaacacuucgcuccccuuccagaauauucacccuauaacaaucgguaagugcccaaaauauguuaagucuaccaaacugcgccuugccacugggcugagaaacgugcccuccauucagucaaggggauuguuuggcgcgaucgccggcuucauagaagggggauggacagguaugguagacggcugguacggguaucaucaccagaaugaacaaggaaguggcuacgcagcugaccucaagagcacccagaacgccauugaugagaucacgaauaaagugaacuccgucaucgagaagaugaauacccaguuuacagcuguggguaaggaguucaaccaccuggaaaaacggauugaaaauuuaaacaagaaaguugacgauggguuccuggacaucuggacuuacaaugccgagcuccuugugcuguuggaaaacgagcgcacccuagauuaucaugacucuaaugucaagaaccuguacgagaaagugcgaagccagcucaagaacaaugcaaaggaaauuggcaacggauguuuugaguucuaucacaaaugcgauaauacauguauggaaucaguaaagaacggcacuuacgacuauccuaaauacagugaggaagccaagcugaauagagaggagauagaugggguuaaacuugaauccaccaggaucuaucaaauucuggcuaucuacagcacaguggcgucuucauugguccucguggucagucugggagcaaucagcuuuuggaugugcuccaacgguucuuuacagugccggauuuguauauga

SEQ ID NO: 126404 - RNA, 1701 nt, Artificial Sequence
  derived and/or modified sequence opt3 from hemagglutinin__InfluenzaA__ADD97541
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucauacgggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcaccgaucaacagaguuuguaccagaacgccgacgcucauguguucgucgggacaucucgcuacuccaagaaauuuaagccugagauugccauccgaccaaaagugcgugaucaggagggaagaaugaauuauuacuggacucugguggaacccggugacaagauuaccuucgaggcgacaggcaaccuagucguuccuagguaugcauuugccauggaacggaacgcugggagcggaaucauaauuucggauaccccagugcacgacugcaauacgacuugucaaacaccgaaaggcgccaucaacaccucucuccccuuccagaauauucauccuaucacuaucgguaagugcccaaaguacguaaaauccacaaagcugcgccuugcaaccgggcugagaaacauucccucaauacagaguaggggauuguuuggcgcuaucgccggcuucauugaagggggauggacggguaugguggacggcugguauggguaccaccaccagaaugaacaaggaagcggcuaugcggccgaucucaaauccacccagaacgcaaucgacgagauaacaaauaaggucaacucugugauugagaaaaugaauacucaguuuaccgcuguugguaaggaguucaaccaucuggaaaagcggaucgaaaauuuaaacaaaaagguggaugacggguuccuggauaucuggacauacaaugccgagcuccuuguccuguuggaaaacgagcgcacucuagacuaccacgauagcaaugugaaaaaccuguaugagaagguacgaucacagcucaaaaacaaugcuaaggaaauuggcaacggauguuuugaguucuaccauaagugcgacaauaccuguauggaaaguguuaaaaacggcacauaugauuacccuaaguauuccgaggaagccaaacugaauagagaggagaucgacggggugaaacuugaaagcaccaggauuuaccaaauacuggcaaucuauucuacugucgccucaaguuuggugcucgucgugagccugggagcuauuuccuuuuggaugugcucuaacgguucguuacagugccggaucuguaucuga

SEQ ID NO: 126405 - RNA, 1701 nt, Artificial Sequence; identical to SEQ ID NO: 126237
  derived and/or modified sequence opt3 from hemagglutinin__InfluenzaA__ADD97551

SEQ ID NO: 126406 - RNA, 1701 nt, Artificial Sequence; identical to SEQ ID NO: 125849
  derived and/or modified sequence opt3 from hemagglutinin__InfluenzaA__ADD97561

SEQ ID NO: 126407 - RNA, 1701 nt, Artificial Sequence
  derived and/or modified sequence opt3 from hemagglutinin__InfluenzaA__ADD97571
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcagugugucccuguucgaacgguuugagauuuucccgaagacaucuagcuggcccaaccacgacuccaauaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcauccaccaccccuccacgucagcugaccaacagagccuguaccagaaugccgaugcguacguguucgucgggacuucccgcuauucuaagaaauuuaagccugagauugcaauccgaccaaaagugcgugaccaggagggaagaaugaacuacuauuggacccuaguggaacccggugauaagauuacauucgaggccacuggcaaccucgucguuccuagguacgcuuuugccauggaacggaaugcaggguccggaaucauaauuagcgacaccccagugcaugauugcaacacaaccugucaaacgccgaaaggcgcuaucaauacuucgcugcccuuccagaacauucacccuaucacaaucgguaagugcccaaaguauguaaaaucuaccaagcugcgccuugccacuggguugagaaaugugcccuccauucagucaaggggacucuuuggcgcgauagccggcuucaucgaagggggauggacagguauggucgacggcugguacggguaucaucaccagaacgaacaaggaaguggcuacgcagcugaccugaaaagcacccagaaugccauugauaagaucacgaacaaagugaauaguguuauagagaagaugaacacccaguuuacagcuguggguaaggaguucaaucacuuagaaaaacggauugagaaccugaauaagaaagucgacgauggguuccucgacaucuggacuuacaacgccgaacuucugguguugcuagagaaugaacgcacccuggauuaucaugacucuaacguaaagaaccucuacgagaaaguucgaagccagcugaagaauaacgcaaaggagaucggcaauggauguuuugaguucuaucacaaaugcgauaacacauguauggaaucagugaagaauggcacuuacgacuauccuaaauacagugaagaggccaaacuuaacagagaagagauugauggggucaagcuggaguccaccaggaucuaucaaauuuuggcuauauacagcacaguggcgucuucacucguccuggugguuaguuuaggagcaaucagcuuuuggaugugcuccaaugguucucugcagugccggauuuguaucuga

SEQ ID NO: 126408 - RNA, 1701 nt, Artificial Sequence; identical to SEQ ID NO: 124685
  derived and/or modified sequence opt3 from hemagglutinin__InfluenzaA__ADD97581

SEQ ID NO: 126409 - RNA, 1701 nt, Artificial Sequence; identical to SEQ ID NO: 124685
  derived and/or modified sequence opt3 from hemagglutinin__InfluenzaA__ADD97591

SEQ ID NO: 126410 - RNA, 1701 nt, Artificial Sequence; identical to SEQ ID NO: 124685
  derived and/or modified sequence opt3 from hemagglutinin__InfluenzaA__ADD97688

SEQ ID NO: 126411 - RNA, 1701 nt, Artificial Sequence; identical to SEQ ID NO: 126237
  derived and/or modified sequence opt3 from hemagglutinin__InfluenzaA__ADD97698

SEQ ID NO: 126412 - RNA, 1701 nt, Artificial Sequence; identical to SEQ ID NO: 126237
  derived and/or modified sequence opt3 from hemagglutinin__InfluenzaA__ADD97888

SEQ ID NO: 126413 - RNA, 1701 nt, Artificial Sequence
  derived and/or modified sequence opt3 from hemagglutinin__InfluenzaA__ADD97898
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacauucccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 126414 - RNA, 1701 nt, Artificial Sequence; identical to SEQ ID NO: 125038
  derived and/or modified sequence opt3 from hemagglutinin__InfluenzaA__ADD97908

SEQ ID NO: 126415 - RNA, 1701 nt, Artificial Sequence; identical to SEQ ID NO: 125849
  derived and/or modified sequence opt3 from hemagglutinin__InfluenzaA__ADD97918

SEQ ID NO: 126416 - RNA, 1701 nt, Artificial Sequence
  derived and/or modified sequence opt3 from hemagglutinin__InfluenzaA__ADD97928
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugggaucacgaauaaggugaacucuguuauagagaaaaugaauacccaguuuacagcugugggcaaggaguucaaccaccuggaaaagcggauugagaauuuaaacaaaaaggucgacgauggauuccuggacaucuggacuuacaaugccgaacuccuugugcuguuggagaacgaacgcacccuagauuaucaugacagcaauguaaagaaccuguacgagaagguucgaucacagcucaaaaacaaugcaaaggagaucggcaacggguguuuugaguuccaccauaagugcgauaauacauguauggagagugugaaaaacggaacuuaugacuacccuaaguauuccgaagaggccaaacugaauagagaagagauugauggugucaaacuugagagcaccaggaucuaccaaauucuggcuauauauucuacaguggcgucaaguuugguccucgugguuagccugggcgcaaucuccuuuuggaugugcucuaacgggucguuacagugccggauuuguaucuga

SEQ ID NO: 126417 - RNA, 1701 nt, Artificial Sequence
  derived and/or modified sequence opt3 from hemagglutinin__InfluenzaA__ADD97938
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaugacaagcuccuggcccaaucacgauucaaacaagggugugaccgccgcuuguccucaugcaggggccaagaguuuuuauaaaaaucugauauggcucgucaagaaaggaaacagcuacccaaaguuaucuaaauccuauaucaaugacaagggcaaggaaauucuggugcuuuggggcauccaccaccccucaacgagcgcugaucaacagaguuuguaccagaacgccgacgcguacguauucguugggacuucucgcuauuccaaaaaguuuaaaccugagauugcaauccgaccaaaggugcgugaucaggagggaagaaugaauuacuauuggacccuggucgaacccggugacaaaauaacauucgaggccacuggcaaccuaguggugccuagguacgcuuuugccauggaacggaacgcagggagcggaauuaucauuucggauaccccaguccaugacugcaauacaaccugucaaacgccgaagggcgcuaucaacacuucucuccccuuccagaauauccacccuauuacaauagguaaaugcccaaaguauguuaaguccaccaaacugcgccuugccacugggcugagaaacgugcccucaauccagaguaggggauuguuuggcgcgauugccggcuucaucgaagggggauggacagguaugguagacggcugguacggguaucaucaccagaaugaacaaggaagcggcuacgcagcugaucucaaguccacccagaacgccauagacgagauuacgaauaaagugaacucugucaucgagaagaugaauacccaguuuacagcuguggguaaagaguucaaccaccuggaaaagcggaucgaaaauuuaaacaagaaaguugaugacggguuccuggauauuuggacuuacaaugccgagcuccuugugcuguuggaaaacgagcgcacccuagacuaucaugauagcaaugucaagaaccuguacgagaaagugcgaucacagcucaagaacaaugcaaaagaaaucggcaacggauguuuugaguucuaucacaagugcgacaauacauguauggaaaguguaaagaacggcacuuacgauuauccuaaauacuccgaggaagccaagcugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 126418 - RNA, 1701 nt, Artificial Sequence
  derived and/or modified sequence opt3 from hemagglutinin__InfluenzaA__ADD97948
augaaggccauccugcucgugcuucuguacaccuucgcuacagcaaacgccgacacuuugugcauuggcuaucacgcgaauaacagcacggauaccgucgacacaguuuuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaggagcugagggagcagcugagcaguguuuccucuuucgaacgguuugagauguucccgaagacaagcuccuggcccaaucacgauucaaacaagggugugaccgccgcuuguccucaugcaggggccaaaaguuuuuauaagaaucucauuugguuagucaaaaagggaaacagcuacccaaaacugucuaaguccuauaucaaugacaagggcaaagaagugcuuguauuguggggcauacaccaccccucaacgagcgcugaucaacagagucuguaccagaacgccgacgcguacguuuucguggggacuucucgcuauuccaagaaauuuaagccugagaucgcaauucgaccaaaaguccgugaucaggagggaagaaugaauuacuauuggacccuaguggaacccggugacaagaucacauucgaggccacuggcaaccucguggucccuagguacgcuuuugccauggaacggaacgcagggagcggaauuaucauaucggauaccccaguucaugacugcaauacaaccugucaaacgccgaaaggcgcuauuaacacuucucugcccuuccagaauauccacccuauuacaaucgguaagugcccaaaguaugugaaauccaccaaacuucgccuggccacuggguugagaaacguacccucaauccagaguaggggacucuuuggcgcgauugccggcuucauagaagggggauggacagguaugguggacggcugguacggguaucaucaccagaaugaacaaggaagcggcuacgcagcugaucugaaguccacccagaacgccaucgacgagauuacgaauaaggucaacucugugaucgagaaaaugaauacccaguuuacagcuguugguaaggaguucaaccacuuagaaaagcggauagaaaaucugaacaaaaagguggaugacggguuccucgauauuuggacuuacaaugccgagcuucuggucuugcuagaaaacgagcgcacccuggacuaucaugauagcaaugugaaaaaccucuacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacuuaauagagaggagaucgacggggugaagcuggaaagcaccaggauuuaucaaaucuuggcuauuuacucuacagucgcgucaagucucgugcuggucgugagcuuaggagcaauauccuuuuggaugugcucuaacgguucgcugcagugccggaucuguauuuga

SEQ ID NO: 126419 - RNA, 1701 nt, Artificial Sequence
  derived and/or modified sequence opt3 from hemagglutinin__InfluenzaA__ADD97958
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuucagccugagauugcaauccgaccaaaggugcgugaucaagagggaagaaugaauuacuauuggacccugcuagaacccggugacaaaauuacauucgaggccacuggcaaccucguggucccuagguacgcuuuugccauggaacggaacgcagggagcggaaucauaauuucggauaccccaguucaugacugcaauacaaccugucagacgccgaagggcgcuaucaacacuucucugcccuuccagaauauucacccuaucacaaucgguaaaugcccaaaguaugugaaguccaccaaacuucgccuggccacuggguugagaaacguacccucaauucagaguaggggacucuuuggcgcgauagccggcuucaucgaagggggauggacagguaugguggacggcugguacggguaucaucaccaaaaugaacagggaagcggcuacgcagcugaucugaaguccacccagaacgccauugacgagaucacgaauaaagucaacucugugauagagaagaugaauacccaguuuacagcuguugguaaagaguucaaccacuuagaaaagcggauugaaaaucugaacaagaaaguggaugacggguuccucgauaucuggacuuacaaugccgagcuucuggucuugcuagaaaacgagcgcacccuggacuaucaugauagcaaugugaagaaccucuacgagaaaguacgaucacaacugaagaacaaugcaaaagaaaucggcaacggauguuuugaguucuaucacaagugcgacaauacauguauggaaaguguuaagaacggcacuuacgauuauccuaaauacuccgaggaagccaaacuuaauagagaggagauugacggggugaagcuggaaagcaccaggaucuaucagauuuuggcuauauacucuacagucgcgucaagucucgugcuggucgugagcuuaggagcaaucuccuuuuggaugugcucuaacgguucgcugcagugccggauuuguaucuga

SEQ ID NO: 126420 - RNA, 1701 nt, Artificial Sequence; identical to SEQ ID NO: 124685
  derived and/or modified sequence opt3 from hemagglutinin__InfluenzaA__ADD97968

SEQ ID NO: 126421 - RNA, 1701 nt, Artificial Sequence; identical to SEQ ID NO: 126413
  derived and/or modified sequence opt3 from hemagglutinin__InfluenzaA__ADD97978

SEQ ID NO: 126422 - RNA, 1701 nt, Artificial Sequence; identical to SEQ ID NO: 126367
  derived and/or modified sequence opt3 from hemagglutinin__InfluenzaA__ADD97988

SEQ ID NO: 126423 - RNA, 1701 nt, Artificial Sequence
  derived and/or modified sequence opt3 from hemagglutinin__InfluenzaA__ADD97998
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaaggccagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugaaauggagcggaacgcagggagcggaaucauaauuucggauacuccagugcaugacugcaauaccacaugucaaaccccgaaaggcgcuaucaacacgucucuccccuuccagaauauucacccuaucacuaucgguaagugcccaaaguauguaaaauccacaaagcugcgccuugccaccgggcugagaaacgugcccucaauucagaguaggggauuguuuggcgcgauagccggcuucaucgaagggggauggacugguauggucgacggcugguacggguaucaucaccagaaugagcaaggaagcggcuacgcagcugaucucaaauccacacagaacgccauugacgagaucaccaauaaggugaacucuguuauagaaaagaugaauacgcaguuuaccgcuguggguaaggaguucaaccaccuggaaaagcggauugagaauuuaaacaaaaaggucgaugacggguuccuggauaucuggacauacaaugccgaacuccuugugcuguuggagaacgagcgcacucuagacuaucaugauagcaauguuaaaaaccuguacgaaaagguacgaucacagcucaaaaacaaugcaaaggagaucggcaacggauguuuugaguucuaucacaagugcgacaauaccuguauggagagugugaaaaacggcacauacgauuauccuaaguacuccgaagaggccaaacugaauagagaggaaauugacggggucaaacuugagagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 126424 - RNA, 1701 nt, Artificial Sequence; identical to SEQ ID NO: 126237
  derived and/or modified sequence opt3 from hemagglutinin__InfluenzaA__ADD98008

SEQ ID NO: 126425 - RNA, 1701 nt, Artificial Sequence
  derived and/or modified sequence opt3 from hemagglutinin__InfluenzaA__ADD98018
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaauccugguacuuuggggcauucaccaccccucaacgagcgcugaucaacagaguuuguaccagaacgccgacgcguacguuuucguggggacuucucgcuauuccaagaaauuuaagccugagaucgcaacccgaccaaaaguccgugagcaggaaggaagaaugaauuacuauuggacacugguggagcccggugauaagauuacuuucgaagccaccggcaaccuaguggucccuagguacgcuuuugccauggagcggaacgcagggagcggaaucauaauuucggacacaccaguucaugauugcaauaccacgugucaaacuccgaaaggcgcuaucaacacaucucuccccuuccagaauauucacuccaucaccaucgguaagugcccuaaguaugugaaaucaacuaagcugcgccuugccacagggcugagaaacguaccaaguauucagagcaggggauuguuuggcgcgauagccggcuucaucgaagggggauggaccgguaugguggacggcugguacggguaucaucaccagaaugagcaaggauccggcuacgcagcugaccucaaaucuacgcagaacgccauugaugagaucaccaauaaggucaacagcgugauagaaaagaugaauacacaguuuacugcuguugguaaggaguucaaccaccuggaaaagcggauugagaauuuaaacaaaaagguggacgauggguuccuggacaucuggaccuacaaugccgaacuccuuguccuguuggagaacgagcgcacacuagauuaucaugacucaaaugugaaaaaccuguacgaaaagguacgaagucagcucaaaaacaaugcaaaggagaucggcaacggauguuuugaguucuaucacaagugcgauaauacuuguauggaguccguuaaaaacggcaccuacgacuaucccaaguacagcgaagaggccaaacugaauagagaggaaauugauggggugaaacuugagucuacaaggaucuaucaaauucuggcuauauacucaaccgucgcgaguagcuuggugcucgucgugucccugggagcaaucucuuuuuggaugugcucgaacgguagcuuacagugccggauuuguaucuga

SEQ ID NO: 126426 - RNA, 1701 nt, Artificial Sequence; identical to SEQ ID NO: 126389
  derived and/or modified sequence opt3 from hemagglutinin__InfluenzaA__ADD98028

SEQ ID NO: 126427 - RNA, 1701 nt, Artificial Sequence
  derived and/or modified sequence opt3 from hemagglutinin__InfluenzaA__ADD98038
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuauuucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaaggccagcuccuggcccaaucacgauucaaacaagggugucacagcugcauguccucaugccggggcuaaaaguuuuuauaagaaucugauauggcuggugaaaaagggaaacagcuacccaaaacucucuaaguccuauaucaaugacaagggcaaagaaguauuaguucuguggggcauucaccaccccucaaccagcgccgaucaacagagucuuuaccagaacgcggacgcauacguguucgucgggacgucucgcuauuccaagaaauuuaagccugagaucgccauucgaccaaaagugcgugaucaggagggaagaaugaauuacuauuggacuuugguggaacccggugacaagaucaccuucgaggcuacaggcaaccuggucguuccuagguacgccuuugaaauggagcggaacgcagggagcggaauaauuaucucggauacuccagugcaugacugcaauaccacaugucaaaccccgaaaggcgcuauuaacacgucucuacccuuccagaauauccacccuaucacuauugguaagugcccaaaguauguaaaauccacaaagcuccgccuggccaccgggcuuagaaacgugcccucaauacagaguaggggacuguuuggcgcgaucgccggcuucauugaagggggauggacugguauggucgacggcugguacggguaucaucaccagaaugagcaaggaagcggcuacgcagcugauuugaaauccacacagaacgccaucgacgagauaaccaauaaggugaacucuguuauugaaaagaugaauacgcaguuuaccgcuguggguaaagaguucaaccaccucgaaaagcggaucgagaaucugaacaaaaaggucgaugacggguucuuagauaucuggacauacaaugccgaacugcucgugcuucuggagaacgagcgcacuuuggacuaucaugauagcaauguuaaaaaccuauacgaaaagguacgaucacagcugaaaaacaaugcaaaggagauuggcaacggauguuuugaguucuaucacaagugcgacaauaccuguauggaaagugugaaaaacggcacauacgauuauccuaaguacuccgaagaggccaaacucaauagagaggaaaucgacggggucaagcuggagagcacuaggauuuaucaaauacuugcuaucuacucuaccguggcgucaagucuggucuuggugguuagccucggagcaauuuccuuuuggaugugcucuaacgguucgcugcagugccggaucuguaucuga

SEQ ID NO: 126428 - RNA, 1701 nt, Artificial Sequence; identical to SEQ ID NO: 126413
  derived and/or modified sequence opt3 from hemagglutinin__InfluenzaA__ADD98048

SEQ ID NO: 126429 - RNA, 1701 nt, Artificial Sequence; identical to SEQ ID NO: 124685
  derived and/or modified sequence opt3 from hemagglutinin__InfluenzaA__ADD98058

SEQ ID NO: 126430 - RNA, 1701 nt, Artificial Sequence; identical to SEQ ID NO: 124685
  derived and/or modified sequence opt3 from hemagglutinin__InfluenzaA__ADD98068

SEQ ID NO: 126431 - RNA, 1701 nt, Artificial Sequence; identical to SEQ ID NO: 124927
  derived and/or modified sequence opt3 from hemagglutinin__InfluenzaA__ADD98078

SEQ ID NO: 126432 - RNA, 1701 nt, Artificial Sequence
  derived and/or modified sequence opt3 from hemagglutinin__InfluenzaA__ADD98098
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcagugaucaacagucuuuguaccagaacgcugacgccuacguuuucguggggacuucccgcuauagcaagaaauuuaagccugagaucgcgauucgaccaaaaguccgugaucaggagggaagaaugaauuacuauuggacccugguggaacccggugacaagaucacauucgaggcaacuggcaaccuaguggucccuagguacgccuuugcuguugaacggaacgccgggucgggaauaauuaucucugauaccccagugcaugacugcaauacaaccugucaaacgccgaaaggcgcaauuaacacuucccuccccuuccagaauauccacccuaucacaauugguaagugcccaaaguauguaaaaucaaccaagcugcgccuugcuacugggcugagaaacgugcccaguauacagagcaggggauuguuuggcgccaucgcgggcuucauugaagggggauggacagguauggucgacggcugguacggguaucaucaccagaaugaacaaggauccggcuacgccgcagaucucaaaucuacccagaacgcuaucgacgagauaacgaauaaggugaacagcguuauugagaaaaugaauacccaguuuacagccguggguaaggaguucaaccaccuggaaaagcggaucgaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaauuggcaacggauguuuugaguucuaucacaagugcgacaauacauguauggaauccgugaaaaacggcacuuacgauuauccuaaguacagcgaggaagcaaaacugaauagagaggagaucgacggggucaaacuugaaucuaccaggauuuaucaaauacuggccaucuacucaacaguggcuaguagcuugguccucgugguuucccugggagcgauuucuuuuuggaugugcucgaacgguagcuuacagugccggaucuguaucuga

SEQ ID NO: 126433 - RNA, 1701 nt, Artificial Sequence; identical to SEQ ID NO: 126400
  derived and/or modified sequence opt3 from hemagglutinin__InfluenzaA__ADD98118

SEQ ID NO: 126434 - RNA, 1701 nt, Artificial Sequence; identical to SEQ ID NO: 126400
  derived and/or modified sequence opt3 from hemagglutinin__InfluenzaA__ADD98128

SEQ ID NO: 126435 - RNA, 1701 nt, Artificial Sequence
  derived and/or modified sequence opt3 from hemagglutinin__InfluenzaA__ADD98138
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcacugaccaacagaguuuguaccagaaugcugaugccuacguguucgucgggaccucucgcuauuccaagaaauuuaagccugagauugcgauccgaccaaaagugcgugaccaggagggaagaaugaacuacuauuggacacugguggaacccggugauaagauuacuuucgaggcaaccggcaaccuagucguuccuagguacgccuuugcuauggaacggaauacagggagcggaaucauaauuucggacaccccagugcaugauugcaacacgacuugucaaacaccgaauggcgccaucaacaccucucuccccuuccagaauauucacccuaucacuaucgguaaaugcccaaaguauguaaaguccacaaaacugcgccuugcaaccgggcugagaaacgugcccucaauucagaguaggggauuguuuggcgcuauagccggcuucaucgaagggggauggacggguauggucgacggcugguacggguaucaucaccagaaugaacaaggaagcggcuacgcggccgaccucaaguccacccagaacgcaauugauaaaaucacaaauaaggugaacucuguuauagagaaaaugaauacucaguuuaccgcuguggguaaggaguucaaccaccuggaaaagcggauugagaauuuaaacaaaaaggucgacgauggguuccuggacaucuggacauacaaugccgaacuccuugugcuguuggagaacgaacgcacucuagauuaucaugacagcaacguaaagaaucuguacgagaagguucgaucacagcucaaaaacaaugcuaaggagaucggcaacggauguuuugaguucuaucacaagugcgauaauaccuguauggaaagugugaaaaacggcacauacgacuauccuaaguacuccgaagaggccaaacugaauagagaagagauugauggggucaaacuugagagcaccaggaucuaucaaauucuggcaauauacucuacuguggccucaaguuugguccucgugguuagccugggagcuaucuccuuuuggaugugcucuaacgguucguuacagugccggauuuguaucuga

SEQ ID NO: 126436 - RNA, 1701 nt, Artificial Sequence
  derived and/or modified sequence opt3 from hemagglutinin__InfluenzaA__ADD98148
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucuucauaucggauaccccagugcaugacugcaauacaaccugucaaacgccgaaaggcgcuauuaacacuucucuccccuuucagaauauccacccuauuacaaucgguaagugcccaaaguauguaaaauccaccaagcugcgccuugccacugggcugagaaacgugcccucaauccagaguaggggauuguucggcgcgauugccggcuuuauagaagggggauggacagguauggucgacggcugguacggguaucaucaccagaaugaacaaggaagcggcuacgcagcugaucucaaauccacccagaacgccaucgacaagauuacgaauaaagugaacucuguuaucgagaagaugaauacccaguucacagcuguggguaaggaguucaaccaccuggaaaaacggauagagaauuuaaacaagaaagucgaugacggguuucuggauauuuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuucgaauuuuaucacaaaugcgacaauacauguauggagagugugaagaacggcacuuacgauuauccuaaauacuccgaagaggccaagcugaauagagaagagaucgacggggucaaacuugagagcaccaggauuuaucaaauccuggcuauuuacucuacaguggcgucaaguuugguccucgugguuagccugggagcaauauccuucuggaugugcucuaacgguucguuacagugccggaucuguauuuga

SEQ ID NO: 126437 - RNA, 1701 nt, Artificial Sequence
  derived and/or modified sequence opt3 from hemagglutinin__InfluenzaA__ADD98158
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuaugugagcucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucaucccuagguacgcuuuugccauggagcggaacgcagggagcggaauaauuaucucggauaccccaguucaugacugcaauacaaccugucaaacgccgaagggcgcuauuaacacuucucuccccuuccagaauauccacccuaucacaauugguaaaugcccaaaguaugugaaguccaccaaacugcgccuugccacugggcugagaaacguacccucaauacagaguaggggauuguuuggcgcgaucgccggcuucauugaagggggauggacagguaugguggacggcugguacggguaucaucaccagaaugagcaaggaagcggcuacgcagcugaucucaaguccacccagaacgccaucgacaaaauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 126438 - RNA, 1701 nt, Artificial Sequence
  derived and/or modified sequence opt3 from hemagglutinin__InfluenzaA__ADD98168
augaaggccauccuggugguccuccuuuacaccuucgcuacagcaaacgccgacacucugugcauuggcuaucacgcgaauaacagcacggauaccguugacacaguguuggagaaaaauguaacugugacccauuccauaaacaucuuagaagauaagcacaaugggaaacuguguaagcuaagaggagucgcuccccuccaucuggguaaaugcaacauugccggcuggauccuugggaauccugagugugaaucucugucaacagcaaguagcugguccuacauuguggagaccucuucgucagacaacggaacuugcuauccaggcgauuuuaucgacuacgaagaguugagggagcagcucagcaguguuuccucuuucgaacgguuugagauauucccgaagacaagcuccuggcccaaucacgauucaaacaagggugugaccgccgcuuguccucaugcaggggccaaaaguuuuuauaagaaucugaucuggcuggucaaaaagggaaacagcuacccaaaacucucuaaguccuauauuaaugacaagggcaaagaaguguuaguacuguggggcauccaccaccccucaacgagcgcugaucaacagagucuuuaccagaacgccgacgcguacguuuucguggggacuucucgcuauuccaagaaauuuaagccugagauugcaauccgaccaaaaguccgugaucaggagggaagaaugaauuacuauuggaccuugguggaacccggugacaagauaacauucgaggccacuggcaaccugguggucccuaaauacgcuuuugccauggaaaggaacgcagggagcggaauuaucauuucggauaccccaguucaugacugcaauacaaccugucaaacgccgaagggcgcuaucaacacuucucuacccuuccagaauauccacccuauuacaauagguaagugcccaaaauaugugaaguccaccaaacuccggcuggccacugggcuucgcaacguacccucaauccagaguagaggacuguuuggcgcgauugccggcuucaucgaagggggauggacagguaugguggacggcugguacggguaucaucaccagaaugaacaaggaagcggcuacgcagcugauuugaaguccacccagaacgccauagacgagauuacgaauaaagucaacucugugaucgagaagaugaauacccaguuuacagcuguugguaaggaguucaaccaccucgagaaaaggaucgaaaaucugaacaagaaaguggaugacggguucuuagauauuuggacuuacaaugccgagcugcucguccuucuggaaaacgagcggaccuuggacuaucaugauagcaaugugaagaaccuauacgagaaaguacgcucacagcugaagaacaaugcaaaggaaaucggcaacggauguuuugaguucuaucacaaaugcgacaauacauguauggaaaguguuaagaacggcacuuacgauuauccuaaauacuccgaggaagccaagcucaaucgagaggagauugacggggugaaacuggaaagcaccagaauauaucaaauccuugcuauuuacucuacagucgcgucaagucugguguuggucgugagccucggagcaaucuccuuuuggaugugcucuaacgguucgcugcagugcaggaucuguauuuga

SEQ ID NO: 126439 - RNA, 1701 nt, Artificial Sequence; identical to SEQ ID NO: 125857
  derived and/or modified sequence opt3 from hemagglutinin__InfluenzaA__ADD98188

SEQ ID NO: 126440 - RNA, 1701 nt, Artificial Sequence
  derived and/or modified sequence opt3 from hemagglutinin__InfluenzaA__ADD98198
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagaugcgccuggccacugggcuuagaaacgugcccucaauucagaguaggggacuguuuggcgcgauagccggcuucaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguuuacagcuguggguaaggaguucaaccaccucgaaaagcggauugaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacucaauagagaggagauugacggggucaagcuggaaagcaccaggaucuaucaaauucuugcuauauacucuacaguggcgucaagucuggucuuggugguuagccucggagcaaucuccuuuuggaugugcucuaacgguucgcugcagugccggauuuguaucuga

SEQ ID NO: 126441 - RNA, 1701 nt, Artificial Sequence; identical to SEQ ID NO: 124685
  derived and/or modified sequence opt3 from hemagglutinin__InfluenzaA__ADD98208

SEQ ID NO: 126442 - RNA, 1701 nt, Artificial Sequence; identical to SEQ ID NO: 124865
  derived and/or modified sequence opt3 from hemagglutinin__InfluenzaA__ADE20321

SEQ ID NO: 126443 - RNA, 1701 nt, Artificial Sequence; identical to SEQ ID NO: 124865
  derived and/or modified sequence opt3 from hemagglutinin__InfluenzaA__ADE20331

SEQ ID NO: 126444 - RNA, 1701 nt, Artificial Sequence; identical to SEQ ID NO: 124865
  derived and/or modified sequence opt3 from hemagglutinin__InfluenzaA__ADE20341

SEQ ID NO: 126445 - RNA, 1701 nt, Artificial Sequence; identical to SEQ ID NO: 126273
  derived and/or modified sequence opt3 from hemagglutinin__InfluenzaA__ADE20351

SEQ ID NO: 126446 - RNA, 1701 nt, Artificial Sequence; identical to SEQ ID NO: 124865
  derived and/or modified sequence opt3 from hemagglutinin__InfluenzaA__ADE20375

SEQ ID NO: 126447 - RNA, 1701 nt, Artificial Sequence; identical to SEQ ID NO: 126273
  derived and/or modified sequence opt3 from hemagglutinin__InfluenzaA__ADE20388

SEQ ID NO: 126448 - RNA, 1701 nt, Artificial Sequence; identical to SEQ ID NO: 124865
  derived and/or modified sequence opt3 from hemagglutinin__InfluenzaA__ADE20628

SEQ ID NO: 126449 - RNA, 1701 nt, Artificial Sequence; identical to SEQ ID NO: 126273
  derived and/or modified sequence opt3 from hemagglutinin__InfluenzaA__ADE20638

SEQ ID NO: 126450 - RNA, 1701 nt, Artificial Sequence; identical to SEQ ID NO: 124865
  derived and/or modified sequence opt3 from hemagglutinin__InfluenzaA__ADE20648

SEQ ID NO: 126451 - RNA, 1701 nt, Artificial Sequence; identical to SEQ ID NO: 124865
  derived and/or modified sequence opt3 from hemagglutinin__InfluenzaA__ADE20658

SEQ ID NO: 126452 - RNA, 1701 nt, Artificial Sequence; identical to SEQ ID NO: 126273
  derived and/or modified sequence opt3 from hemagglutinin__InfluenzaA__ADE20668

SEQ ID NO: 126453 - RNA, 1701 nt, Artificial Sequence; identical to SEQ ID NO: 126273
  derived and/or modified sequence opt3 from hemagglutinin__InfluenzaA__ADE20678

SEQ ID NO: 126454 - RNA, 1701 nt, Artificial Sequence; identical to SEQ ID NO: 124865
  derived and/or modified sequence opt3 from hemagglutinin__InfluenzaA__ADE20688

SEQ ID NO: 126455 - RNA, 1701 nt, Artificial Sequence; identical to SEQ ID NO: 124865
  derived and/or modified sequence opt3 from hemagglutinin__InfluenzaA__ADE20708

SEQ ID NO: 126456 - RNA, 1701 nt, Artificial Sequence; identical to SEQ ID NO: 124865
  derived and/or modified sequence opt3 from hemagglutinin__InfluenzaA__ADE20718

SEQ ID NO: 126457 - RNA, 1701 nt, Artificial Sequence
  derived and/or modified sequence opt3 from hemagglutinin__InfluenzaA__ADE20728
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaaaaggaguggcuccccuccaucuggguaagugcaacaucgccggcuggauucuugggaauccugagugugaaucucugucaacagcaaguagcugguccuacaucguugagaccucuucgucagacaacggaacuugcuauccaggcgauuuuauugacuacgaagaguugagagagcagcucagcaguguguccucuuucgaaagguuugagaucuucccgaagacaagcuccuggcccaaucacgauucaaacaaaggugucaccgccgcuuguccucaugcaggggccaagaguuuuuauaaaaaucugauauggcuggugaagaaaggaaacagcuacccaaagcucucuaaguccuauaucaaugacaaaggcaaggaaguauuaguucuguggggcauucaccaccccucaacgagcgcugaucaacagagucuuuaccagaacgccgacgcguacguguucgucgggucuuccaaauauagcaagaaauuuaagccugagaucgcaauucggccaaaagugcgcgaucaggagggacgaaugaauuacuauuggacuuugguggaacccggugacaagaucaccuucgaggccacaggcaaccuggucguuccucguuacgcuuuugccauggaaagaaacgcagggucgggaauaauuaucucugauacuccagugcaugacugcaauaccacaugucaaaccccgaagggcgcuauuaacacgucccuacccuuccagaauauccacccuaucacuauugguaaaugcccaaaguauguaaaaucaacaaagcucaggcuggccaccgggcuucggaacgugcccaguauacagagccgcggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaagaugaauacgcaguuuaccgcuguggguaaagaguucaaccaccucgagaagagaaucgaaaaucugaacaaaaaggucgaugacggguucuuagauaucuggacauacaaugccgagcugcucgugcuucuggaaaacgagaggacuuuggacuaucaugauucaaauguuaaaaaccuauacgagaagguacggagucagcugaagaacaaugcaaaagaaauuggcaacggauguuuugaguucuaucacaagugcgacaauaccuguauggaauccgugaaaaacggcacauacgauuauccuaaguacagcgaggaagccaaacucaaucgcgaggagaucgacggggucaagcuggaaucuacucgaauuuaucaaauacuugcuaucuacucaaccguggcgaguagccuggucuuggugguuucccucggagcaauuucuuuuuggaugugcucgaacgguagccugcagugcagaaucuguaucuga

SEQ ID NO: 126458 - RNA, 1701 nt, Artificial Sequence; identical to SEQ ID NO: 124865
  derived and/or modified sequence opt3 from hemagglutinin__InfluenzaA__ADE20738

SEQ ID NO: 126459 - RNA, 1701 nt, Artificial Sequence; identical to SEQ ID NO: 124865
  derived and/or modified sequence opt3 from hemagglutinin__InfluenzaA__ADE20748

SEQ ID NO: 126460 - RNA, 1701 nt, Artificial Sequence; identical to SEQ ID NO: 126457
  derived and/or modified sequence opt3 from hemagglutinin__InfluenzaA__ADE20758

SEQ ID NO: 126461 - RNA, 1701 nt, Artificial Sequence; identical to SEQ ID NO: 124865
  derived and/or modified sequence opt3 from hemagglutinin__InfluenzaA__ADE20768

SEQ ID NO: 126462 - RNA, 1701 nt, Artificial Sequence
  derived and/or modified sequence opt3 from hemagglutinin__InfluenzaA__ADE20778
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaaaaggaguggcuccccuccaucuggguaagugcaacaucgccggcuggauucuugggaauccugagugugaaucucugucaacagcaaguagcugguccuacaucguugagaccucuucgucagacaacggaacuugcuauccaggcgauuuuauugacuacgaagaguugagagagcagcucagcaguguguccucuuucgaaagguuugagaucuucccgaagacaagcuccuggcccaaucacgauucaaacaaaggugucaccgccgcuuguccucaugcaggggccaagaguuuuuauaaaaaucugauauggcuggugaagaaaggaaacagcuacccaaagcucucuaaguccuauaucaaugacaaaggcaagaaaguauuaguucuguggggcauucaccaccccucaacgagcgcugaucaacagagucuuuaccagaacgccgacgcguacguguucgucgggucuuccaaguauagcaaaaaguuuaaaccugaaaucgcaauucggccaaaggugcgcgaucaggagggacgaaugaauuacuauuggacuuugguggagcccggugacaagaucaccuucgaagccacaggcaaccuggucguuccucguuacgcuuuugccauggagagaaacgcagggucgggaauaauuaucucugauacuccagugcaugacugcaauaccacaugucaaaccccgaaaggcgcuauuaacacgucccuacccuuccagaauauccacccuaucacuauugguaagugcccaaaauauguaaagucaacaaaacucaggcuggccaccgggcuucggaacgugcccaguauacagagccgcggacuguuuggcgcgaucgccggcuucauugaagggggauggacugguauggucgacggcugguacggguaucaucaccagaaugagcaaggauccggcuacgcagcugauuugaagucuacacagaacgccaucgacgaaauaaccaauaaggugaacagcguuauugagaaaaugaauacgcaguuuaccgcuguggguaaggaguucaaccaccucgagaaaagaaucgaaaaucugaacaagaaagucgaugacggguucuuagauaucuggacauacaaugccgaacugcucgugcuucuggagaacgaaaggacuuuggacuaucaugauucaaauguaaagaaccuauacgagaagguucggagucagcugaaaaacaaugcaaaggagauuggcaacggauguuuugaguucuaucacaaaugcgacaauaccuguauggaauccgugaagaacggcacauacgauuauccuaaauacagcgaagaggccaagcucaaucgcgaagagaucgacggggucaagcuggagucuacucgaauuuaucaaauacuugcuaucuacucaaccguggcgaguagccuggucuuggugguuucccucggagcaauuucuuuuuggaugugcucgaacgguagccugcagugcagaaucuguaucuga

SEQ ID NO: 126463 - RNA, 1701 nt, Artificial Sequence; identical to SEQ ID NO: 125849
  derived and/or modified sequence opt3 from hemagglutinin__InfluenzaA__ADE20788

SEQ ID NO: 126464 - RNA, 1701 nt, Artificial Sequence
  derived and/or modified sequence opt3 from hemagglutinin__InfluenzaA__ADE20808
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaaggaaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacaagaucacgaauaaagugaacucuguuauagagaagaugaauacccaguuuacagcugugggcaaggaguucaaccaccuggagaaacggauugaaaauuuaaacaagaaagucgaugacgguuuccuggauaucuggacuuacaaugccgagcuccuugugcuguuggaaaacgagcgcacccuagacuaucaugauagcaauguaaagaaccuguacgagaaaguucgaucacagcucaagaacaaugcaaaggaaaucgggaacggcuguuuugaguucuaucacaaaugcgacaauacauguauggaaagugugaagaacggaacuuacgauuauccuaaauacuccgaggaagccaagcugaauagagaggagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 126465 - RNA, 1701 nt, Artificial Sequence; identical to SEQ ID NO: 125849
  derived and/or modified sequence opt3 from hemagglutinin__InfluenzaA__ADE20818

SEQ ID NO: 126466 - RNA, 1701 nt, Artificial Sequence; identical to SEQ ID NO: 126407
  derived and/or modified sequence opt3 from hemagglutinin__InfluenzaA__ADE20828

SEQ ID NO: 126467 - RNA, 1701 nt, Artificial Sequence
  derived and/or modified sequence opt3 from hemagglutinin__InfluenzaA__ADE20848
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguaugauugacggcugguacggguaucaucaccagaacgaacaaggaagcggcuacgcagcugaccucaaauccacccagaaugccaucgauaagauaacgaacaaagucaauucugugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaccuguacgagaaaguacgaucacagcucaagaauaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126468 - RNA, 1701 nt, Artificial Sequence; identical to SEQ ID NO: 125849
  derived and/or modified sequence opt3 from hemagglutinin__InfluenzaA__ADE20858

SEQ ID NO: 126469 - RNA, 1701 nt, Artificial Sequence
  derived and/or modified sequence opt3 from hemagglutinin__InfluenzaA__ADE20868
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugacaaccgcaucaaguuggagcuacauuguugagacuuccucuucggauaacggcacaugcuauccaggugacuuuaucgauuacgaagaacucagggagcagcugucaagcgugaguuccuucgaacgguuugagauguucccgaagaccucuagcuggcccaaucacgacuccaacaagggggucacggccgcuuguccucaugcaggagccaaaucauuuuauaagaaucugauuuggcucgugaaaaagggcaacaguuacccaaaauuaagcaagucuuauaucaaugauaagggcaaagaaguacugguucuuugggggauacaccaccccuccacuucagcugaccaacagagcuuguaccagaacgccgaugcguacguguucgucggaaccagucgcuauucuaagaaauuuaagccugagaucgcaauucgaccaaaagugcgugaccaggaggguagaaugaauuacuauuggacacugguggaacccggcgauaagaucacuuucgaggccaccgggaaccuagucguuccuagguacgcuuuugccauggaacggaacgcaggauccggcauuaucauaagcgacacaccagugcaugauugcaauaccacgugucaaacuccgaaaggugcuauuaacacaucgcuccccuuccagaauauccacccuauuaccaucgggaagugcccaaaguauguaaaaucuacuaagcugcgccuugccacaggacugagaaacgugcccuccauccagucaaggggcuuguuuggcgcgauugccggguucauagagggagguuggaccggcauggucgacgggugguacggauaucaucaccagaaugaacaaggcagugguuacgcagcugaccucaaaagcacgcagaacgccaucgaugagauuaccaauaaggugaacuccguuaucgagaaaaugaauacacaguuuacugcuguggggaaggaguucaaccaccuggagaagcggauagaaaauuuaaacaaaaaggucgacgauggcuuccuggacauuuggaccuacaaugccgagcuccuugugcuguuggaaaacgagcgcacacuagauuaucaugacucuaauguaaagaaccuguacgagaagguucgaagccagcucaaaaacaaugcaaaggaaaucggaaacggcuguuuugaguucuaucacaagugcgauaauacuuguauggaaucagugaaaaacgggaccuacgacuauccuaaguacagugaggaagccaaacugaauagagaggagaucgauggagucaaacuugaauccacaaggauuuaucaaauccuggcuauuuacagcaccguggcgucuucauugguccucgugguuagucugggugcaaucagcuuuuggaugugcuccaacggcucuuuacagugccggauauguauuuga

SEQ ID NO: 126470 - RNA, 1701 nt, Artificial Sequence; identical to SEQ ID NO: 126403
  derived and/or modified sequence opt3 from hemagglutinin__InfluenzaA__ADE20878

SEQ ID NO: 126471 - RNA, 1701 nt, Artificial Sequence; identical to SEQ ID NO: 125787
  derived and/or modified sequence opt3 from hemagglutinin__InfluenzaA__ADE20888

SEQ ID NO: 126472 - RNA, 1701 nt, Artificial Sequence
  derived and/or modified sequence opt3 from hemagglutinin__InfluenzaA__ADE20898
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggaacggaacgcagggagcggaauuaucauuucggauaccccaguccaugacugcaauacaaccugucaaacgccgaaaggcgcuaucaacacuucucuccccuuccagaauauccacccuauuacaauagguaagugcccaaaguauguuaaauccaccaagcugcgccuugccacugggcugagaaacgugcccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaggcguaaagaacgggacuuacgauuauccuaaguacagugaggaagccaaacugaauagagaggagauugacggaguuaaacuugaauccaccaggauauaucaaauccuggcuauuuacagcacaguggcgucuucauugguccucguggucagucugggugcaaucagcuuuuggaugugcuccaacggcucuuuacagugccggaucuguauuuga

SEQ ID NO: 126473 - RNA, 1701 nt, Artificial Sequence; identical to SEQ ID NO: 126436
  derived and/or modified sequence opt3 from hemagglutinin__InfluenzaA__ADE20908

SEQ ID NO: 126474 - RNA, 1701 nt, Artificial Sequence
  derived and/or modified sequence opt3 from hemagglutinin__InfluenzaA__ADE20918
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaucuugguggaacccggugacaagauaaccuucgaggccacaggcaaccuggucguuccuagguacgcuuuugccauggaacggaacgcagggagcggaauuaucauuucggauacuccagugcaugacugcaauaccacaugucaaaccccgaaaggcgcuaucaacacgucucuacccuuccagaauauccacccuauuacuauagguaagugcccaaaguauguaaaauccacaaagcuccgccuggccaccgggcuuagaaacgugcccucaauccagaguaggggacuguuuggcgcgauugccggcuucaucgaagggggauggacugguauggucgacggcugguacggguaucaucaccagaaugaacaaggaagcggcuacgcagcugauuugaaauccacacagaacgccauagacgagauuaccaauaaggugaacucuguuaucgagaaaaugaauacgcaguuuaccgcuguggguaaggaguucaaccaccucgagaagcggaucgaaaaucugaacaaaaaggucgaugacggguucuuagauauuuggacauacaaugccgagcugcucgugcuucuggaaaacgagcgcacuuuggacuaucaugauagcaauguuaaaaaccuauacgagaagguacgaucacagcugaaaaacaaugcaaaggaaaucggcaacggauguuuugaguucuaucacaagugcgacaauaccuguauggaaagugugaaaaacggcacauacgauuauccuaaguacuccgaggaagccaaacucaauagagaggagauugacggggucaagcuggaaagcacuaggauauaucaaauccuugcuauuuacucuaccguggcgucaagucuggucuuggugguuagccucggagcaaucuccuuuuggaugugcucuaacgguucgcugcagugccggaucuguauuuga

SEQ ID NO: 126475 - RNA, 1701 nt, Artificial Sequence; identical to SEQ ID NO: 125038
  derived and/or modified sequence opt3 from hemagglutinin__InfluenzaA__ADE20928

SEQ ID NO: 126476 - RNA, 1701 nt, Artificial Sequence
  derived and/or modified sequence opt3 from hemagglutinin__InfluenzaA__ADE20948
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgauucuuacguguucgucgggacuucccgcuauagcaagaaauuuaagccugagauugcgauccgaccaaaagugcgugaccaggagggaagaaugaacuacuauuggacccugguggaacccggugauaagauuacauucgaggcaacuggcaaccuagucguuccuagguacgccuuugcuauggaacggaaugccgggucgggaaucauaauuucugacaccccagugcaugauugcaacacaaccugucaaacgccgaaaggcgcaaucaauacuucccuccccuuccagaacauucacccuaucacaaucgguaagugcccaaaguauguaaaaucaaccaagcugcgccuugcuacugggcugagaaaugugcccaguauucagagcaggggauuguuuggcgccauagcgggcuucaucgaagggggauggacagguauggucgacggcugguacggguaucaucaccagaacgaacaaggauccggcuacgccgcagaccucaaaucuacccagaaugcuauugauaagaucacgaacaaagugaauagcguuauagagaagaugaacacccaguuuacagccguggguaaggaguucaaucaccuggaaaaacggauugagaacuuaaauaagaaagucgacgauggguuccuggacaucuggacuuacaacgcugaacuccuugugcuguuggagaaugaacgcacccuagauuaucaugacucaaacguaaagaaccuguacgagaaaguucgaagucagcucaagaauaacgccaaggagaucggcaauggauguuuugaguucuaucacaaaugcgauaacacauguauggaauccgugaagaauggcacuuacgacuauccuaaauacagcgaagaggcaaagcugaacagagaagagauugauggggucaaacuugagucuaccaggaucuaucaaauucuggccauauacucaacaguggcuaguagcuugguccucgugguuucccugggagcgaucucuuuuuggaugugcucgaaugguagcuuacagugccggauuuguaucuga

SEQ ID NO: 126477 - RNA, 1701 nt, Artificial Sequence
  derived and/or modified sequence opt3 from hemagglutinin__InfluenzaA__ADE20968
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagaggcuccccugcaucuugguaaaugcaacauagccggcuggauccuggggaauccugaaugugagucuuugucaacagcaaguagcugguccuacauuguggaaaccucuucgucagacaacggaacuugcuauccaggcgauuuuaucaauuacgaggagcucagggaacagcugagcaguguuuccucuuucgagcgguuugaaauuuucccgaagacaagcuccuggcccaaccacgacucaaauaagggugugaccgccgcuuguccucauaguggggcaaagagcuuuuauaaaaaccugaucuggcucgucaaaaagggaaauucuuacccaaaauuauccaagucauauauaaacgauaagggcaaagaggugcugguacuuuggggcauccaccaccccagcacgagugccgaccaacagucuuuguaccagaaugcugaugccuacguuuucguggggacuucccgcuauagcaagaaauuuaagccugagauugcgauccgaccaaaaguccgugaccaggaaggaagaaugaacuacuauuggacccugguggagcccggugauaagauuacauucgaagcaacuggcaaccuaguggucccuagguacgccuuugcuauggagcggaaugccgggucgggaaucauaauuucugacaccccaguucaugauugcaacacaaccugucaaacgccgaaaggcgcaaucaauacuucccuccccuuccagaacauucacccuaucacaaucgguaagugcccaaaguaugugaaaucaaccaagcugcgccuugcuacugggcugagaaauguacccaguauucagagcaggggauuguuuggcgccauagcgggcuucaucgaagggggauggacagguaugguggacggcugguacggguaucaucaccagaacgagcaaggauccggcuacgccgcagaccucaaaucuacccagaaugcuauugauaagaucacgaacaaagucaauagcgugauagagaagaugaacacccaguuuacagccguugguaaggaguucaaucaccuggaaaaacggauugaaaacuuaaauaagaaaguggacgauggguuccuggacaucuggacuuacaacgcugagcuccuuguccuguuggaaaaugagcgcacccuagauuaucaugacucaaacgugaagaaccuguacgagaaaguacgaagucagcucaagaauaacgccaaggaaaucggcaauggauguuuugaguucuaucacaaaugcgauaacacauguauggaauccguuaagaauggcacuuacgacuauccuaaauacagcgaggaagcaaagcugaacagagaggagauugauggggugaaacuugaaucuaccaggaucuaucaaauucuggccauauacucaacagucgcuaguagcuuggugcucgucgugucccugggagcgaucucuuuuuggaugugcucgaaugguagcuuacagugccggauuuguaucuga

SEQ ID NO: 126478 - RNA, 1701 nt, Artificial Sequence; identical to SEQ ID NO: 125849
  derived and/or modified sequence opt3 from hemagglutinin__InfluenzaA__ADE20978

SEQ ID NO: 126479 - RNA, 1701 nt, Artificial Sequence
  derived and/or modified sequence opt3 from hemagglutinin__InfluenzaA__ADE20988
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacauucccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaagagagaggagaucgacggggugaaacuugaaagcacaaggauuuaucaaauacuggccaucuacucuaccgucgcuucaaguuuggugcucgucgugagccugggagcgauuuccuuuuggaugugcucuaaugguucguuacagugccggaucuguaucuga

SEQ ID NO: 126480 - RNA, 1701 nt, Artificial Sequence; identical to SEQ ID NO: 125849
  derived and/or modified sequence opt3 from hemagglutinin__InfluenzaA__ADE20998

SEQ ID NO: 126481 - RNA, 1701 nt, Artificial Sequence; identical to SEQ ID NO: 126013
  derived and/or modified sequence opt3 from hemagglutinin__InfluenzaA__ADE21008

SEQ ID NO: 126482 - RNA, 1701 nt, Artificial Sequence
  derived and/or modified sequence opt3 from hemagglutinin__InfluenzaA__ADE21018
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcaccgaucaacagaguuuguaccagaacgccgacgcuuacguguucgucgggacaucucgcuauuccaagaaauuuaagccugagauugccauccgaccaaaagugcgugaucaggagggaagaaugaauuacuauuggacucugguggaacccggugacaagauuaccuucgaggcgacaggcaaccuagucguuccuagguacgcauuugccauggaacggaacgcugggagcggaaucauaauuucggauaccccagugcaugacugcaauacgacuugucaaacaccgaaaggcgccaucaacaccucucuccccuuccagaauauucacccuaucacuaucgguaagugcccaaaguauguaaaauccacaaagcugcgccuugcaaccgggcugagaaacauucccucaauacagaguaggggauuguuuggcgcuaucgccggcuucauugaagggggauggacggguaugguggacggcugguacggguaucaucaccagaaugaacaaggaagcggcuacgcggccgaucucaaauccacccagaacgcaaucgacgagauaacaaauaaggucaacucugugauugagaaaaugaauacucaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcuaaggaaauuggcaacggauguuuugaguucuaucacaagugcgacaauaccuguauggaaaguguuaaaaacggcacauacgauuauccuaaguacuccgaggaagccaaacugaauagagaggagaucgacggggugaaacuugaaagcaccaggauuuaucaaauacuggcaaucuacucuacugucgccucaaguuuggugcucgucgugagccugggagcuauuuccuuuuggaugugcucuaacgguucguuacagugccggaucuguaucuga

SEQ ID NO: 126483 - RNA, 1701 nt, Artificial Sequence; identical to SEQ ID NO: 126423
  derived and/or modified sequence opt3 from hemagglutinin__InfluenzaA__ADE21028

SEQ ID NO: 126484 - RNA, 1701 nt, Artificial Sequence; identical to SEQ ID NO: 126413
  derived and/or modified sequence opt3 from hemagglutinin__InfluenzaA__ADE21038

SEQ ID NO: 126485 - RNA, 1701 nt, Artificial Sequence; identical to SEQ ID NO: 126436
  derived and/or modified sequence opt3 from hemagglutinin__InfluenzaA__ADE21048

SEQ ID NO: 126486 - RNA, 1701 nt, Artificial Sequence
  derived and/or modified sequence opt3 from hemagglutinin__InfluenzaA__ADE21058
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaauuaauuacuauuggacccugguggaacccggugacaagaucacauucgaggccacuggcaaccuagucguuccuagguacgcuuuugccauggaacggaacgcagggagcggaauaauuaucucggauaccccagcucaugacugcaauacaaccugucaaacgccgaaaggcgccauuaacacuucucuccccuuccagaauauccacccuaucacaauugguaagugcccaaaguaugugaaauccaccaagcugcgccuugcgacugggcugagaaacguacccucaauacagaguaggggauuguuuggcgccaucgcaggcuucauugaagggggauggacagguaugguggacggcugguacggguaucaucaccagaaugaacaaggaagcggcuacgcugccgaucucaaauccacccagaacgcuaucgacaagauaacgaauaaagucaacucugugauugagaagaugaauacccaguuuacagccguugguaaggaguucaaccaccuggaaaaacggaucgagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagauuggcaacggauguuuugaguucuaucacaaaugcgacaauacauguauggaaaguguuaagaacggcacuuacgauuauccuaaauacuccgaagaggcuaagcugaauagagaagagaucgacggggugaaacuugagagcaccaggauuuaucaaauacuggcgaucuacucuacagucgcaucaaguuuggugcucgucgugagccugggagccauuuccuuuuggaugugcucuaacgguucguuacagugccggaucuguaucuga

SEQ ID NO: 126487 - RNA, 1701 nt, Artificial Sequence
  derived and/or modified sequence opt3 from hemagglutinin__InfluenzaA__ADE21068
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguacgaagucagcucaaaaacaaugcaaaggagacaggcaacggauguuuugaguucuaucacaagugcgauaauacuuguauggaguccgugaaaaacggcaccuacgacuaucccaaguacagcgaagaggccaaacugaauagagaggaaaucgauggggucaaacuugagucuacaaggauuuaucaaauccuggcuauuuacucaaccguggcgaguagcuugguccucgugguuucccugggagcaauaucuuuuuggaugugcucgaacgguagcuuacagugccggaucuguauuuga

SEQ ID NO: 126488 - RNA, 1698 nt, Artificial Sequence
  derived and/or modified sequence opt3 from hemagglutinin__InfluenzaA__ADE28761
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgggaaucagaaaacgcuguaccauacugagaacgccuacgucuccguggugucaagccacuauagucgcaaguucacccccgaaauagcuaagcgaccuaaaguccgugaccaggagggaagaaucaauuacuauuggacacuucuggagccaggugauacuauuaucuuugaagcaaacggcaauuugauugccccgagguacgcuuucgcccucucucggggguuuggauccggcaucauaaacagcaaugcgcccauggacaagugugaugcaaaaugccagaccccucaaggugccauuaacucgucucugccauuccagaauguucaucccgugacaaucggggaguguccuaaguauguacgcuccgcuaaauuaagaauggugaccggacugaggaacauuccaucaauccagagucggggccucuuuggcgccaucgcaggguucauugaaggagguuggacgggcauggucgacgggugguacggauaucaccaccagaaugagcaaggcagcgguuacgcugccgaucagaaguccacucagaacgcgauaaaugggaucacaaacaaaguaaauucuguuauugaaaagaugaacacccaguuuacugccgugggcaaggaguucaacaaacuugagcgccgaauggaaaaucugaacaagaaagucgacgauggauucaucgacauauggacauacaaugcagaguugcuagugcugcucgaaaacgagagaacccuggauuuucaugaaagcaauguaaagaaccuuuaugagaaaguuaagucacaacugaagaauaacgcuaaagagauuggcaaugggugcuucgaauuuuaccacaaguguaacgacgagugcauggaaagugugaaaaauggaacguaugacuaccccaaguauuccgaggagagcaaauugaacagggaaaagaucgauggugucaagcucgagucuauggaaguguaccagauccuggccauuuauucaaccgucgcuaguagcuuagugcugcuaguuucccucggcgccaucucuuucuggaugugcucgaaugggagccugcagugucggauuugcauauga

SEQ ID NO: 126489 - RNA, 1701 nt, Artificial Sequence; identical to SEQ ID NO: 124865
  derived and/or modified sequence opt3 from hemagglutinin__InfluenzaA__ADE28780

SEQ ID NO: 126490 - RNA, 1701 nt, Artificial Sequence; identical to SEQ ID NO: 126273
  derived and/or modified sequence opt3 from hemagglutinin__InfluenzaA__ADE28790

SEQ ID NO: 126491 - RNA, 1701 nt, Artificial Sequence; identical to SEQ ID NO: 126457
  derived and/or modified sequence opt3 from hemagglutinin__InfluenzaA__ADE28800

SEQ ID NO: 126492 - RNA, 1701 nt, Artificial Sequence; identical to SEQ ID NO: 125849
  derived and/or modified sequence opt3 from hemagglutinin__InfluenzaA__ADE28810

SEQ ID NO: 126493 - RNA, 1701 nt, Artificial Sequence
  derived and/or modified sequence opt3 from hemagglutinin__InfluenzaA__ADE28820
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggucuccugagugugaaucauugaguacagcaagcuccuggucuuacauuguugagaccucgucaagcgacaauggaacuugcuauccaggcgauuuuaucgacuacgaggagcucagggagcagcugaguuccgugucuagcuucgaacgguuugagauuuucccgaagacauccucauggcccaaccacgauaguaauaagggugucaccgccgcuuguccucaugcaggggccaagagcuuuuauaaaaaccugaucuggcucgugaaaaagggaaauucuuacccaaaauuauccaagucauauauaaacgacaagggcaaagaaguacugguucuuuggggcauccaccaccccagcacgagugcugaucaacagucuuuguaccagaaugccgacgcguacguguucgucgggacuucccgcuauagcaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucgggaaucauaauuucugauaccccagugcaugacugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacaagaucacgaacaaagugaauagcguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucaaacguaaagaaucuguacgagaaaguucgaagucagcucaagaacaacgcaaaggagaucggcaauggauguuuugaguucuaucacaaaugcgacaacacauguauggaauccgugaagaauggcacuuacgauuauccuaaauacagcgaagaggccaagcugaacagagaagagauugacggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 126494 - RNA, 1701 nt, Artificial Sequence; identical to SEQ ID NO: 124865
  derived and/or modified sequence opt3 from hemagglutinin__InfluenzaA__ADE28830

SEQ ID NO: 126495 - RNA, 1701 nt, Artificial Sequence; identical to SEQ ID NO: 124865
  derived and/or modified sequence opt3 from hemagglutinin__InfluenzaA__ADE28840

SEQ ID NO: 126496 - RNA, 1701 nt, Artificial Sequence; identical to SEQ ID NO: 124865
  derived and/or modified sequence opt3 from hemagglutinin__InfluenzaA__ADE28850

SEQ ID NO: 126497 - RNA, 1701 nt, Artificial Sequence; identical to SEQ ID NO: 124865
  derived and/or modified sequence opt3 from hemagglutinin__InfluenzaA__ADE28881

SEQ ID NO: 126498 - RNA, 1701 nt, Artificial Sequence; identical to SEQ ID NO: 124865
  derived and/or modified sequence opt3 from hemagglutinin__InfluenzaA__ADE28891

SEQ ID NO: 126499 - RNA, 1701 nt, Artificial Sequence; identical to SEQ ID NO: 126368
  derived and/or modified sequence opt3 from hemagglutinin__InfluenzaA__ADE28911

SEQ ID NO: 126500 - RNA, 1701 nt, Artificial Sequence; identical to SEQ ID NO: 125849
  derived and/or modified sequence opt3 from hemagglutinin__InfluenzaA__ADE28921

SEQ ID NO: 126501 - RNA, 1701 nt, Artificial Sequence; identical to SEQ ID NO: 125849
  derived and/or modified sequence opt3 from hemagglutinin__InfluenzaA__ADE28931

SEQ ID NO: 126502 - RNA, 1701 nt, Artificial Sequence; identical to SEQ ID NO: 125038
  derived and/or modified sequence opt3 from hemagglutinin__InfluenzaA__ADE28951

SEQ ID NO: 126503 - RNA, 1701 nt, Artificial Sequence
  derived and/or modified sequence opt3 from hemagglutinin__InfluenzaA__ADE28961
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacguugccggcuggauacuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 126504 - RNA, 1701 nt, Artificial Sequence; identical to SEQ ID NO: 126389
  derived and/or modified sequence opt3 from hemagglutinin__InfluenzaA__ADE28971

SEQ ID NO: 126505 - RNA, 1701 nt, Artificial Sequence
  derived and/or modified sequence opt3 from hemagglutinin__InfluenzaA__ADE28981
augaaggccauccuggugguccuccuuuacaccuucgcuacagcaaacgccgacacucugugcauuggcuaucacgcgaauaacagcacggagaccguugauacaguguuggagaaaaauguaacugugacccauuccgucaacuuacuggaagacaagcacaaugggaaacuauguaagcucagaggaguggcuccccugcaucuugguaaaugcaacauagccggcuggauccuggggaauccugaaugugagucuuugucaacagcaaguagcugguccuacauuguugaaaccucuucgucagauaacggaacuugcuauccaggcgacuuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugauaagaucacgaauaaagugaacucuguuauagagaagaugaauacccaguuuacagcuguggguaaggaguucaaccaccuggaaaaacggauugaaaauuuaaacaagaaagucgacgauggguuccuggacaucuggacuuacaaugccgagcuccuugugcuguuggaaaacgagcgcacccuagauuaucaugacagcaauguaaagaaccuguacgagaaaguucgaucacagcucaagaacaaugcaaaggaaaucggcaacggauguuuugaguucuaucacaaaugcgauaauacauguauggaaagugugaagaacggcacuuacgacuauccuaaauacuccgaggaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126506 - RNA, 1701 nt, Artificial Sequence; identical to SEQ ID NO: 125849
  derived and/or modified sequence opt3 from hemagglutinin__InfluenzaA__ADE28991

SEQ ID NO: 126507 - RNA, 1701 nt, Artificial Sequence
  derived and/or modified sequence opt3 from hemagglutinin__InfluenzaA__ADE29001
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaagggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126508 - RNA, 1701 nt, Artificial Sequence; identical to SEQ ID NO: 124927
  derived and/or modified sequence opt3 from hemagglutinin__InfluenzaA__ADE29011

SEQ ID NO: 126509 - RNA, 1701 nt, Artificial Sequence
  derived and/or modified sequence opt3 from hemagglutinin__InfluenzaA__ADE29021
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuggaucggacaacggcacuugcuauccaggugauuuuaucgacuacgaggaacucagggagcagcugucaagcgugaguuccuucgaacgguuugagauuuucccgaagacaucuagcuggcccaaucacgauuccaacaagggggucaccgccgcuuguccucaugcaggagccaaaucauuuuauaagaaucugaucuggcucgugaaaaagggcaacaguuacccaaaauuaagcaagucuuauauaaaugacaagggcaaagaaguacugguucuuugggggauccaccaccccuccacgucaacugaucaacagagcuuguaccagaacgcugacgccuacgugagugucggaaccucucgcuauuccaagaaauucaagccugagauugcgauccgaccaaaagugcgugaucaggaggguagaaugaauuacuauuggacacugguggaacccggcgacaagauuacuuuugaggcaaccgggaaccuagucguuccuagguacgccuucgcuauggaacggaacgccggaagcggcaucauaauuucggauacaccagugcaugacugcaauaccacgugucaaacuccgaaaggugcaaucaacacaucucuccccuuucagaauauucacccuaucaccaucgggaagugcccaaaguauguaaaauccacuaagcugcgccuugcuacaggacugagaaacgugcccucaauucagaguaggggcuuguucggcgccauagcgggguuuaucgagggagguuggaccggcauggucgacgggugguacggauaucaucaccagaaugaacaaggcagcgguuacgccgcagaucucaaauccacgcagaacgcuauugacaagaucaccaauaaagugaacucuguuauagagaagaugaauacacaguucacugccguggggaaggaguuuaaccaccuggaaaaacggauugagaauuuaaacaagaaagucgaugacggcuuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggaaacggcuguuucgaauuuuaucacaaaugcgacaauacuuguauggagagugugaagaacgggaccuacgauuauccuaaauacuccgaagaggcaaagcugaauagagaagagauugacggagucaaacuugagagcacaaggaucuaucaaauucuggccauauacucuaccguggcuucaaguuugguccucgugguuagccugggugcgaucuccuucuggaugugcucuaacggcucguuacagugccggauuuguaucuga

SEQ ID NO: 126510 - RNA, 1701 nt, Artificial Sequence; identical to SEQ ID NO: 126334
  derived and/or modified sequence opt3 from hemagglutinin__InfluenzaA__ADE29031

SEQ ID NO: 126511 - RNA, 1701 nt, Artificial Sequence
  derived and/or modified sequence opt3 from hemagglutinin__InfluenzaA__ADE29041
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggagaaaaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaguucaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 126512 - RNA, 1701 nt, Artificial Sequence; identical to SEQ ID NO: 126334
  derived and/or modified sequence opt3 from hemagglutinin__InfluenzaA__ADE29051

SEQ ID NO: 126513 - RNA, 1701 nt, Artificial Sequence
  derived and/or modified sequence opt3 from hemagglutinin__InfluenzaA__ADE29085
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcagaagccaaaucauuuuauaagaaucugaucuggcucgugaaaaaggggaacaguuaccccaaauuaagcaagucuuauauaaaugacaagggaaaagagguacugguucuuuggggcauccaccacccuuccacgucagcugaucaacagagcuuguaccagaacgccgacgcguacguguucgucggcaguucucgcuauuccaagacuuuuaaaccagagauugcaauccgacccaaggugcgugauagagaagggaggaugaauuacuauuggacccugguggagccuggagacaaaauuacauucgaagccacugguaaccuagucguuccacgguacgcuuuugccauggagcgcaacgcaggcagcgggaucauaauuucggauaccccggugcaugacugcaauacaaccugucagacgcccaagggagcuaucaacacuucucucccuuuccaaaauauucacccaaucacaaucggcaaaugccccaaguauguaaaguccaccaaacugagacuugccacuggucugaggaacauuccuucaauacagagucggggguuguuuggagcgaucgccggcuucauugaaggcggguggacaggaaugguggacgguugguacggcuaucaucaccagaaugagcaggggagcggauacgcagcugaucucaaguccacccaaaacgccaucgacgagauaacgaauaaagucaacucugugauugaaaagaugaauacccaguuuacagcuguuggcaaagaguucaaccaccuggaaaagcgcaucgagaauuuaaacaagaaaguggaugacgguuuccuggauaucuggacuuacaaugccgaacuccuuguccuguuggagaacgagcgaacccuagacuaucaugauagcaaugugaagaaccuguacgaaaaaguaagaucacagcucaagaacaaugcaaaagagauugggaacggcuguuuugaguucuaucacaagugcgacaauacauguauggagaguguuaagaacggaacuuacgauuauccaaaauacuccgaagaggccaagcugaauagggaggaaaucgacggcgugaaacuugagagcacccggauuuaucagauacuggcuaucuacucuacagucgcgucaaguuuggugcucgucgugagccugggggcaauuuccuuuuggaugugcucuaacggaucguuacaaugccguaucuguaucuga

SEQ ID NO: 126514 - RNA, 1701 nt, Artificial Sequence
  derived and/or modified sequence opt3 from hemagglutinin__InfluenzaA__ADE29095
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagacuuuuaaaccagagauugcaauccgacccaaggugcgugauagagagggaaggaugaauuacuauuggacccugguggaaccuggugacaaaauuacauucgaggccacuggcaaccuagucguuccacgguacgcuuuugccauggaacgcaacgcagggagcggaaucauaauuucggauaccccggugcaugacugcaauacaaccugucagacgcccaagggcgcuaucaacacuucucucccuuuccaaaauauucacccaaucacaaucgguaaaugccccaaguauguaaaguccaccaaacugagacuugccacugggcugaggaacauuccuucaauacagagucggggauuguuuggcgcgaucgccggcuucauugaagggggauggacagguaugguggacggcugguacggguaucaucaccagaaugaacagggaagcggcuacgcagcugaucucaaguccacccaaaacgccaucgacgagauaacgaauaaagucaacucugugauugagaagaugaauacccaguuuacagcuguugguaaagaguucaaccaccuggaaaagcgcaucgaaaauuuaaacaagaaaguggaugacggguuccuggauaucuggacuuacaaugccgagcuccuuguccuguuggaaaacgagcgaacccuagacuaucaugauagcaaugugaagaaccuguacgagaaaguaagaucacagcucaagaacaaugcaaaagaaauuggcaacggauguuuugaguucuaucacaagugcgacaauacauguauggaaaguguuaagaacggcacuuacgauuauccaaaauacuccgaggaagccaagcugaauagggaggagaucgacggggugaaacuugaaagcacccggauuuaucagauacuggcuaucuacucuacagucgcgucaaguuuggugcucgucgugagccugggagcaauuuccuuuuggaugugcucuaacgguucguuacaaugccguaucuguaucuga

SEQ ID NO: 126515 - RNA, 1701 nt, Artificial Sequence; identical to SEQ ID NO: 125604
  derived and/or modified sequence opt3 from hemagglutinin__InfluenzaA__ADE34191

SEQ ID NO: 126516 - RNA, 1701 nt, Artificial Sequence; identical to SEQ ID NO: 125604
  derived and/or modified sequence opt3 from hemagglutinin__InfluenzaA__ADE34202

SEQ ID NO: 126517 - RNA, 1701 nt, Artificial Sequence
  derived and/or modified sequence opt3 from hemagglutinin__InfluenzaA__ADE34213
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagaaggaaagccuauuccaauuguuaccccuaugacgucccugauuacgcaucuuugcggucgcucguggccucaagcggcacucuggaauuuaacaaugagaguuucaacuggacagguguuacccagaaugggacguccucugcuugcauccgccgaagcaacaauuccuuuuucucacgucugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuaguggcagaauuacugugagcaccaagaggucucagcagacaguaaucccaaacauagggucccggccccgcguuagaaauauuccuucaaggaucagcauuuacuggaccaucgugaaaccaggagauauccugcuaauuaacaguacggguaaucucauagccccgcggggcuacuucaagauccgcucugggaaauccagcauuaugcgaucggacgcgcccaucggaaaguguaacucugaaugcauaacuccuaauggcuccauuccaaacgacaagcccuuucagaaugucaacagaaucacauauggugcauguccuagguacgugaaacaaaauacccugaaacuugccacugggaugcggaacgugccagagaagcagacacguggaaucuucggcgcuauugccggcuuuaucgaaaaugggugggagggaauggucgaugguugguauggcuuccgccaccagaacucagaggggagaggacaagcagcugaccugaagaguacccaggccgcgauugaucagauaaauggcaaauugaacaggcucaucgguaagacgaacgaaaaauuccaccagauugagaaggaauuuagcgagguugaagggcggauccaagaccuggagaaguacguggaggauaccaaaaucgacuuaugguccuauaaugccgaacugcucguagcacuugagaaccagcauacaauugaucugacugacucugaaaugaauaaguuguucgagaaaaccaagaaacagcuacgagaaaacgcugaggauaugggcaauggaugcuuuaagauauaccacaagugugacaacgccugcaucggcagcauucgcaaugggacauaugaucaugacguguacagagacgaggcucugaacaauagguuccagaucaaaggagucgaacucaagucagguuacaaagauuggauucuguggaucaguuuugccauauccugcuuccuucuguguguggcauugcucggcuuuaucaugugggccugccaaaaggggaacauucgguguaauaucugcauuuga

SEQ ID NO: 126518 - RNA, 1701 nt, Artificial Sequence; identical to SEQ ID NO: 125604
  derived and/or modified sequence opt3 from hemagglutinin__InfluenzaA__ADE34224

SEQ ID NO: 126519 - RNA, 1701 nt, Artificial Sequence
  derived and/or modified sequence opt3 from hemagglutinin__InfluenzaA__ADE34235
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggcgcuccaagaauagcuuuuucagucgacugaacuggcucacucauuuaaauuuuaaauauccagcacugaacgugaccaugcccaauaacgagcaguucgauaagcuguacauuuggggaguccaccauccuggcacagacaaagaucagaucuuuuuguaugcccaagcuagcggccguacuaccgugucuacaaagagaucccagcagaccgccauuccaaacaucgggucaaggccccggguacgcaauauaccuagcagaauuaguaucuacuggacgauuguuaaaccaggagacauccugcuaaucaacucuacugguaaucucauugcgccgaggggcuacuucaagauacgguccgggaagucaucgaucaugcgcucugacgcacccauuggaaaauguaacuccgagugcaucacaccuaauggcucaauaccaaacgauaagcccuuucagaaugugaaccgaauuaccuauggugccuguccuagauacgucaaacaaaauacucugaaacuugcuacagggaugaggaacgugccagaaaaacagacccggggaaucuucggcgccaucgcaggcuuuauugagaaugggugggaaggaaugguggacgguugguauggcuuccgucaccagaacagugaggggcgcggacaagcugccgaucuuaagagcacgcaggcggccaucgaccagauuaauggcaaauugaacagacucauagguaagaccaaugagaaguuccaccagaucgaaaaagaguuuuccgaagucgaggggaggauucaagaucuggaaaaguacguugaggacacaaaaaucgauuuauggucuuauaacgcagagcugcucguggcucuugaaaaccagcauacuaucgaccugaccgauagcgagaugaauaaguuguucgaaaagacaaagaagcagcuacgggagaacgccgaagacaugggcaauggaugcuuuaaaauuuaccacaagugugauaacgcuugcauaggcucaauccgaaaugggacuuaugaccaugacguauaccgcgaugaggcccugaacaauagauuccagauuaaaggaguggagcucaagagugguuacaaagacuggauccuguggauuuccuuugcaaucagcugcuuccuucugugugucgccuugcucggcuuuauaaugugggcuugccaaaaggggaacaucagguguaauauuugcaucuga

SEQ ID NO: 126520 - RNA, 1701 nt, Artificial Sequence; identical to SEQ ID NO: 125604
  derived and/or modified sequence opt3 from hemagglutinin__InfluenzaA__ADE34246

SEQ ID NO: 126521 - RNA, 1701 nt, Artificial Sequence; identical to SEQ ID NO: 125629
  derived and/or modified sequence opt3 from hemagglutinin__InfluenzaA__ADE34257

SEQ ID NO: 126522 - RNA, 1701 nt, Artificial Sequence
  derived and/or modified sequence opt3 from hemagglutinin__InfluenzaA__ADE34268
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugaggucccugacuacgcaucguugaggucacucguggccagcaguggcacucuggaauuuaacaaugaguccuucaacuggacagguguuacccaggaugggacgucuagcgcuugcauccggcgcuccaagaauagcuuuuucagucgacugaacuggcucacucauuuaaauuuuaaauauccagcacugaacgugaccaugcccaauaacgagcaguucgacaagcuguacauuuggggaguccaccauccuggcacagauaaagaccagaucuuuuuguaugcccaagcuagcggccguauuacugugucuaccaagagaucccagcagacagccaucccaaacauagggucaaggccccggguacgcaauauuccuagcagaaucaguauuuacuggaccaucguuaaaccaggagauauccugcuaauuaacucuacggguaaucucauagcgccgaggggcuacuucaagauccgguccgggaagucaucgauuaugcgcucugacgcacccaucggaaaauguaacuccgaaugcauaacuccuaauggcucaauuccaaacgacaagcccuuucagaaugugaaccgaaucacauauggugccuguccuagauacgucaaacaaaauacccugaaacuugcuacugggaugaggaacgugccagagaagcagacacggggaaucuucggcgccauugcaggcuuuaucgaaaaugggugggagggaaugguggaugguugguauggcuuccgucaccagaacagugaggggcgcggacaagcugccgaccuuaagagcacccaggcggccauugaucagauaaauggcaaauugaacagacucaucgguaagacgaaugaaaaguuccaccagauugagaaagaauuuuccgaggucgaagggaggauccaagaccuggagaaguacguugaggauaccaaaaucgacuuauggucuuauaacgcagaacugcucguggcucuugagaaccagcauacaauugaucugacugacagcgaaaugaauaaguuguucgagaaaaccaagaagcagcuacgggaaaacgccgaggauaugggcaauggaugcuuuaaaauauaccacaagugugacaacgcuugcaucggcucaauucgaaaugggacauaugaucaugacguauaccgcgacgaggcccugaacaauagauuccagaucaaaggaguggaacucaagagugguuacaaagauuggauucuguggaucuccuuugcaauaagcugcuuccuucugugugucgccuugcucggcuuuaucaugugggcuugccaaaaggggaacauuagguguaauaucugcauuuga

SEQ ID NO: 126523 - RNA, 1701 nt, Artificial Sequence
  derived and/or modified sequence opt3 from hemagglutinin__InfluenzaA__ADE45499
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucaagcgguuugaaauuuucccgaagacaagcuccuggcccaaucacgauccuaacaaaggugucaccgccgcuuguccacaugcaggggccaagucauuuuauaaaaaucugaucuggcucgugaagaaaggaaacaguuaccccaaguuaagcaagucuuauauaaaugacaaaggcaaggagguacugguucuuuggggcauccaccacccuuccacgucagcugaucaacagagcuuguaccagaacgccgacgcguacguguucgucgggaccagucgcuauucuaaaaaguuuaaaccagaaauugcaauccgacccaaggugcgugaucaggagggaagaaugaauuacuauuggacucugguggagccuggugacaaaauuacauucgaagccacuggcaaccuagucguuccaagguacgcuuuugccauggagcggaacgcaggguccggaaucauaauuagcgauaccccggugcaugacugcaauacaaccugucaaacgcccaagggcgcuaucaacacuucgcucccuuuccagaauauucacccaaucacaaucgguaagugccccaaauauguaaagucuaccaaacugcgccuugccacugggcugagaaacgugccuuccauucagucaaggggauuguuuggcgcgauagccggcuucaucgaagggggauggacagguauggucgacggcugguacggguaucaucaccagaaugagcaaggaaguggcuacgcagcugaucucaagagcacccagaacgccauugacgaaaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggagucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 126524 - RNA, 1701 nt, Artificial Sequence; identical to SEQ ID NO: 125483
  derived and/or modified sequence opt3 from hemagglutinin__InfluenzaA__ADE45501

SEQ ID NO: 126525 - RNA, 1701 nt, Artificial Sequence
  derived and/or modified sequence opt3 from hemagglutinin__InfluenzaA__ADE45503
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuagccgcuauucuaagaaauuuaagccagagauugcaauccgacccaaagugcgugaucaggagggaagaaugaauuacuauuggacccugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagagaggagauugacggggucaaacuugaauccaccaggguguaucaaauccuggcuauuuacagcacagucgcgucuucauuggugcucguugugagucugggagcaauaaguuuuuggaugugcuccaacgguucuuuacagugccggaucuguauuuga

SEQ ID NO: 126526 - RNA, 1701 nt, Artificial Sequence; identical to SEQ ID NO: 124685
  derived and/or modified sequence opt3 from hemagglutinin__InfluenzaA__ADE45505

SEQ ID NO: 126527 - RNA, 1701 nt, Artificial Sequence; identical to SEQ ID NO: 125038
  derived and/or modified sequence opt3 from hemagglutinin__InfluenzaA__ADE45507

SEQ ID NO: 126528 - RNA, 1701 nt, Artificial Sequence; identical to SEQ ID NO: 125038
  derived and/or modified sequence opt3 from hemagglutinin__InfluenzaA__ADE45509

SEQ ID NO: 126529 - RNA, 1701 nt, Artificial Sequence; identical to SEQ ID NO: 125483
  derived and/or modified sequence opt3 from hemagglutinin__InfluenzaA__ADE45511

SEQ ID NO: 126530 - RNA, 1701 nt, Artificial Sequence
  derived and/or modified sequence opt3 from hemagglutinin__InfluenzaA__ADE45513
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacgcauucguggggaccagucgcuauucuaagaaauuuaagccagagauugccauccgacccaaaguccgugaucaggagggaagaauuaauuacuauuggacucugguggaaccuggugacaagaucauauucgaggcuacaggcaaccuaguggucccaagguacgccuuugcaauggaacggaacgcuggguccggaauuaucauuagcgauacuccggcccaugacugcaauaccacaugucaaacccccaaaggcgcgaucaacacgucgcucccuuuccagaauauccacccaauuacuauagguaagugccccaaguauguuaaaucuacaaagcugcgccuugccaccgggcugagaaacgugccuuccauccagucaaggggauuguuuggcgcaauugcuggcuucaucgaagggggauggacugguaugguagacggcugguacggguaucaucaccagaaugaacaaggaaguggcuacgccgcugaucucaaaagcacacagaacgccauagacgagauuaccaauaaggugaacuccgucaucgagaaaaugaauacgcaguuuaccgcaguggguaaggaguucaaccaccuggaaaagcggaucgaaaauuuaaacaaaaagguugaugacggguuccuggauauuuggacauacaaugccgagcuccuugugcuguuggaaaacgagcgcacucuagacuaucaugauucuaaugucaaaaaccuguacgagaaggugcgaagccagcucaaaaacaaugcuaaggaaaucggcaacggauguuuugaguucuaucacaagugcgacaauaccuguauggaaucaguaaagaacggcacauacgauuauccaaaguacagugaggaagcgaaacugaauagagaggagauugacgggguuaaacuugaauccacuaggauauaucaaauccuggcaauuuacagcaccguggccucuucauugguccucguggucagucugggagcuaucagcuuuuggaugugcuccaacgguucuuuacagugccggaucuguauuuga

SEQ ID NO: 126531 - RNA, 1701 nt, Artificial Sequence
  derived and/or modified sequence opt3 from hemagglutinin__InfluenzaA__ADE75388
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagaaaacggaacuugcuauccaggcgacuuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126532 - RNA, 1701 nt, Artificial Sequence; identical to SEQ ID NO: 124685
  derived and/or modified sequence opt3 from hemagglutinin__InfluenzaA__ADE75390

SEQ ID NO: 126533 - RNA, 1701 nt, Artificial Sequence; identical to SEQ ID NO: 124685
  derived and/or modified sequence opt3 from hemagglutinin__InfluenzaA__ADF10067

SEQ ID NO: 126534 - RNA, 1701 nt, Artificial Sequence; identical to SEQ ID NO: 124685
  derived and/or modified sequence opt3 from hemagglutinin__InfluenzaA__ADF10077

SEQ ID NO: 126535 - RNA, 1701 nt, Artificial Sequence
  derived and/or modified sequence opt3 from hemagglutinin__InfluenzaA__ADF10087
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccaugaaacggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaaaccagcucaagaauaacgcaaaggagaucggcaauggauguuuugaguucuaucacaaaugcgacaacacauguauggagucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126536 - RNA, 1701 nt, Artificial Sequence
  derived and/or modified sequence opt3 from hemagglutinin__InfluenzaA__ADF10097
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuuccaaauauagcaagaaauuuaagccugagauugcaauccgcccaaaagugcgagaucaggaaggacguaugaauuacuauuggacucugguggagcccggugacaagauuaccuucgaagccacaggcaaccuagucguuccuagauacgcuuuugccauggagaggaacgcagggucgggaaucauaauuucugauacuccagugcaugacugcaauaccacaugucaaaccccgaaaggcgcuaucaacacgucccuccccuuccacaauauucauccuaucacuaucgguaagugcccaaaguauguaaaaucaacaaagcugcggcuugccaccgggcugcgcaacgugcccaguauucagagcagaggauuguuuggcgcgauagccggcuucaucgaagggggauggacugguauggucgacggcugguacggguaucaccaccagaaugagcagggauccggcuacgcagcugaucucaaaucuacacaaaacgccauugacgagaucaccaauaaggugaacagcguuauagaaaagaugaauacgcaguuuaccgcuguggguaaggaguucaaccaucuggaaaagaggauugagaauuuaaacaaaaaggucgaugacggguuccuggauaucuggacauacaaugccgaacuccuugugcuguuggagaacgagcggacucuagacuaucacgauucaaauguuaaaaaccuguacgaaaagguacgcagucagcucaaaaacaaugcaaaggagaucggcaacggauguuuugaguucuaucauaagugcgacaauaccuguauggaauccgugaaaaacggcacauacgauuauccuaaguacagcgaagaggccaaacugaaucgagaggaaauugacggggucaaacuugagucuacuaaaaucuaucagauucuggcuauauacucaaccguggcgaguagcuugguccucgugguuucccugggagcaaucucuuuuuggaugugcucgaacgguagcuuacaaugcagaauuuguaucuga

SEQ ID NO: 126537 - RNA, 1701 nt, Artificial Sequence
  derived and/or modified sequence opt3 from hemagglutinin__InfluenzaA__ADF10107
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaucccccuacgucagcugaucaacagagcuuguaccagaacgccgacgcguacguguucgucgggaguucuaaauauuccaagaaauuuaagccagagauugcaauccgccccaaagugcgagaucaggaaggacguaugaauuacuauuggacucugguggagccuggugacaagauuaccuucgaagccacaggcaaccuagucguuccaagauacgcuuuugccauggagaggaacgcagggagcggaaucauaauuucggauacuccggcucacgacugcaauaccacaugucaaacccccaaaggcgccaucaacacgucucucccuuuccacaauauucauccaaucacuaucgguaagugccccaaguaugugaaauccacaaagcugcggcuugcgaccgggcugcgcaacguaccuucaauucagaguagaggauuguuuggcgccauagcaggcuucaucgaagggggauggacugguaugguggacggcugguacggguaucaccaccagaaugagcagggaagcggcuacgcugccgaucucaaauccacacaaaacgcuauugacgagaucaccaauaaggucaacucugugauagaaaagaugaauacgcaguuuaccgccguugguaaggaguucaaccaucuggaaaagaggauugagaauuuaaacaaaaagguggaugacggguuccuggauaucuggacauacaaugcagaacuccuuguccuguuggagaacgagcggacucuagacuaucacgauagcaaugugaaaaaccuguacgaaaagguacgcucacagcucaaaaacaaugccaaggagaucggcaacggauguuuugaguucuaucauaagugcgacaauaccuguauggaaaguguuaaaaacggcacauacgauuauccaaaguacuccgaagaggcuaaacugaaucgagaggaaauugacggggugaaacuugagagcacuaaaaucuaucagauucuggcgauauacucuaccgucgcaucaaguuuggugcucgucgugagccugggagccaucuccuuuuggaugugcucuaacgguucguuacaaugcagaauuuguaucuga

SEQ ID NO: 126538 - RNA, 1701 nt, Artificial Sequence; identical to SEQ ID NO: 124685
  derived and/or modified sequence opt3 from hemagglutinin__InfluenzaA__ADF10117

SEQ ID NO: 126539 - RNA, 1701 nt, Artificial Sequence; identical to SEQ ID NO: 126389
  derived and/or modified sequence opt3 from hemagglutinin__InfluenzaA__ADF10127

SEQ ID NO: 126540 - RNA, 1701 nt, Artificial Sequence; identical to SEQ ID NO: 124685
  derived and/or modified sequence opt3 from hemagglutinin__InfluenzaA__ADF10137

SEQ ID NO: 126541 - RNA, 1701 nt, Artificial Sequence
  derived and/or modified sequence opt3 from hemagglutinin__InfluenzaA__ADF10154
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugagcaggaaggaagaaugaacuacuauuggacccugguggagcccggugacaagauuacauucgaagccacuggcaaucuagucguuccuagguacgcuuuugccauggagcggaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaucucaaauccacccagaaugccauugacgagaucacgaacaagguaaauucuguuauagagaaaaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugagcgcacccuagacuaucaugauagcaacgugaaaaaucuguacgaacgaguuagaucacagcucaagaacaacgcaaaagagaucggcaauggauguuuugaguucuaucacaagugcgacaacacauguauggaaagugugaagaauggcacuuacgauuauccuaaauacuccgaagaggccaagcugaacagggaggaaauugacggggucaaacuugagagcacccggaucuaucaaauucuggcuauauacucuacaguggcgucaaguuugguccucgugguuagccugggagcaaucuccuuuuggaugugcucuaaugguucguuacagugccguauuuguaucuga

SEQ ID NO: 126542 - RNA, 1701 nt, Artificial Sequence
  derived and/or modified sequence opt3 from hemagglutinin__InfluenzaA__ADF10174
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaacgaguaagaucacagcucaagaacaaugcaaaagagaucggcaacggauguuuugaguucuaucacaagugcgauaauacauguauggaaagugugaagaacggcacuuacgacuauccuaaauacuccgaagaggccaagcugaauagggaggaaauugauggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 126543 - RNA, 1701 nt, Artificial Sequence; identical to SEQ ID NO: 126542
  derived and/or modified sequence opt3 from hemagglutinin__InfluenzaA__ADF10190

SEQ ID NO: 126544 - RNA, 1701 nt, Artificial Sequence; identical to SEQ ID NO: 126389
  derived and/or modified sequence opt3 from hemagglutinin__InfluenzaA__ADF10237

SEQ ID NO: 126545 - RNA, 1701 nt, Artificial Sequence; identical to SEQ ID NO: 126542
  derived and/or modified sequence opt3 from hemagglutinin__InfluenzaA__ADF10262

SEQ ID NO: 126546 - RNA, 1701 nt, Artificial Sequence
  derived and/or modified sequence opt3 from hemagglutinin__InfluenzaA__ADF10288
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaacgaguaagaucacagcucaagaacaaugcaaaagagaucggcaacggauguuuugaguucuaucacaagugcgauaauacauguauggaaagugugaagaacggcacuuacgacuauccuaaauacuccgaagaggccaagcugaauagggaggaaauugauggggucaaacuugagagcacccggaucuaucaaauucuggcuauauacucuacaguggcgucaaguuugguccucgugguuagccugggagcaaucuccuuuuggaugugcucuaacgguucguuacagugccguguguguauuuga

SEQ ID NO: 126547 - RNA, 1701 nt, Artificial Sequence; identical to SEQ ID NO: 126389
  derived and/or modified sequence opt3 from hemagglutinin__InfluenzaA__ADF10302

SEQ ID NO: 126548 - RNA, 1701 nt, Artificial Sequence; identical to SEQ ID NO: 126389
  derived and/or modified sequence opt3 from hemagglutinin__InfluenzaA__ADF10335

SEQ ID NO: 126549 - RNA, 1701 nt, Artificial Sequence; identical to SEQ ID NO: 126389
  derived and/or modified sequence opt3 from hemagglutinin__InfluenzaA__ADF10359

SEQ ID NO: 126550 - RNA, 1701 nt, Artificial Sequence; identical to SEQ ID NO: 126542
  derived and/or modified sequence opt3 from hemagglutinin__InfluenzaA__ADF10369

SEQ ID NO: 126551 - RNA, 1701 nt, Artificial Sequence; identical to SEQ ID NO: 126542
  derived and/or modified sequence opt3 from hemagglutinin__InfluenzaA__ADF10390

SEQ ID NO: 126552 - RNA, 1701 nt, Artificial Sequence; identical to SEQ ID NO: 126389
  derived and/or modified sequence opt3 from hemagglutinin__InfluenzaA__ADF10528

SEQ ID NO: 126553 - RNA, 1701 nt, Artificial Sequence; identical to SEQ ID NO: 126542
  derived and/or modified sequence opt3 from hemagglutinin__InfluenzaA__ADF10598

SEQ ID NO: 126554 - RNA, 1701 nt, Artificial Sequence; identical to SEQ ID NO: 126542
  derived and/or modified sequence opt3 from hemagglutinin__InfluenzaA__ADF10670

SEQ ID NO: 126555 - RNA, 1701 nt, Artificial Sequence; identical to SEQ ID NO: 126542
  derived and/or modified sequence opt3 from hemagglutinin__InfluenzaA__ADF10724

SEQ ID NO: 126556 - RNA, 1701 nt, Artificial Sequence; identical to SEQ ID NO: 126389
  derived and/or modified sequence opt3 from hemagglutinin__InfluenzaA__ADF10757

SEQ ID NO: 126557 - RNA, 1701 nt, Artificial Sequence
  derived and/or modified sequence opt3 from hemagglutinin__InfluenzaA__ADF10828
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 126558 - RNA, 1701 nt, Artificial Sequence; identical to SEQ ID NO: 124685
  derived and/or modified sequence opt3 from hemagglutinin__InfluenzaA__ADF10874

SEQ ID NO: 126559 - RNA, 1701 nt, Artificial Sequence; identical to SEQ ID NO: 125308
  derived and/or modified sequence opt3 from hemagglutinin__InfluenzaA__ADF10929

SEQ ID NO: 126560 - RNA, 1701 nt, Artificial Sequence; identical to SEQ ID NO: 125308
  derived and/or modified sequence opt3 from hemagglutinin__InfluenzaA__ADF10996

SEQ ID NO: 126561 - RNA, 1701 nt, Artificial Sequence; identical to SEQ ID NO: 124685
  derived and/or modified sequence opt3 from hemagglutinin__InfluenzaA__ADF27367

SEQ ID NO: 126562 - RNA, 1701 nt, Artificial Sequence; identical to SEQ ID NO: 124685
  derived and/or modified sequence opt3 from hemagglutinin__InfluenzaA__ADF27369

SEQ ID NO: 126563 - RNA, 1701 nt, Artificial Sequence
  derived and/or modified sequence opt3 from hemagglutinin__InfluenzaA__ADF27370
augaaggccauccuggugauucuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguucugguggggacuucucgcuauuccaagaaauucaagccugagaucgcaauucgaccaaaaguccgugaucaggagggaagaaugaauuacuauuggacccuaguggaacccggugacaagaucacauuugaggccacuggcaaccucguggucccuagguacgcuuucgccauggaacggaacgcagggagcggaauaauuaucucggauaccccaguucaugacugcaauacaaccugucaaacgccgaaaggcgcuauuaacacuucucugcccuuucagaauauccacccuaucacaauugguaagugcccaaaguaugugaaauccaccaaacuucgccuggccacuggguugagaaacguacccucaauacagaguaggggacucuucggcgcgaucgccggcuuuauugaagggggauggacagguaugguggacggcugguacggguaucaucaccagaaugaacaaggaagcggcuacgcagcugaucugaaguccacccagaacgccaucgacaagauaacgaauaaagucaacucugugauugagaagaugaauacccaguucacagcuguugguaaggaguuuaaccacuuagaaaaacggaucgagaaucugaacaagaaaguggaugacggguuccucgauaucuggacuuacaaugccgaacuucuggucuugcuagagaacgaacgcacccuggacuaucaugauagcaaugugaagaaccucuacgagaaaguacgaucacagcugaagaacaaugcaaaggagauuggcaacggauguuucgaauuuuaucacaaaugcgacaauacauguauggagaguguuaagaacggcacuuacgauuauccuaaauacuccgaagaggccaaacuuaauagagaagagaucgacggggugaagcuggagagcaccaggauuuaucaaauauuggcuaucuacucuacagucgcgucaagucucgugcuggucgugagcuuaggagcaauuuccuucuggaugugcucuaacgguucgcugcagugccggaucuguaucuga

SEQ ID NO: 126564 - RNA, 1701 nt, Artificial Sequence; identical to SEQ ID NO: 125857
  derived and/or modified sequence opt3 from hemagglutinin__InfluenzaA__ADF27371

SEQ ID NO: 126565 - RNA, 1701 nt, Artificial Sequence
  derived and/or modified sequence opt3 from hemagglutinin__InfluenzaA__ADF27372
augaaggccauccuggugguccuccuuuacaccuucgcuacagcaaacgccgacacucugugcauuggcuaucacacgaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 126566 - RNA, 1701 nt, Artificial Sequence
  derived and/or modified sequence opt3 from hemagglutinin__InfluenzaA__ADF27373
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucauugaacagcugagcaguguguccucuuucgagagguuugaaaucuucccgaaaacaagcuccuggcccaaucacgauucaaacaagggugucaccgccgcuuguccucaugcaggggccaagaguuuuuauaaaaaucugauauggcucgugaagaaaggaaacagcuacccaaaguuaucuaaauccuauaucaaugacaagggcaaggagguacugguucuuuggggcauucaccaccccucaacgagcgcugaucaacagaguuuguaccagaacgccgacgcguacguguucgucgggucuucccgguauagcaaaaaguuuaaaccugagaucgcaauucgcccaaaggugcgagaucaggaaggacguaugaauuacuauuggacucugguggagcccggugacaaaaucaccuucgaagccacaggcaaccuagucguuccuagauacgcuuuugccauggagaggaacgcagggucgggaauaauuaucucugauacuccagugcaugacugcaauaccacaugucaaaccccgaagggcgcuauuaacacgucccuccccuuccacaauauccauccuaucacuauugguaaaugcccaaaguauguaaagucaacaaaacugcggcuugccaccgggcugcgcaacgugcccaguauacagacuagaggauuguuuggcgcgaucgccggcuucauugaagggggauggacagguauggucgacggcugguacggguaucaccaccagaaugagcagggaagcggcuacgcagcugaucucaaguccacccaaaacgccaucgacgagauaacgaauaaagugaacucuguuauugaaaagaugaauacccaguuuacagcuguggguaaagaguucaaccaucuggaaaagaggaucgagaauuuaaacaagaaagucgaugacggguuccuggauaucuggacuuacaaugccgaacuccuugugcuguuggagaacgagcggacccuagacuaucacgauagcaauguaaagaaccuguacgaaaaaguucgcucacagcucaagaacaaugcaaaagagauuggcaacggauguuuugaguucuaucauaagugcgacaauacauguauggaaagugugaagaacggcacuuacgauuauccuaaauacuccgaagaggccaagcugaaucgagaggaaaucgacggggucaaacuugagagcaccagaauuuaucagauacuggcuaucuacucuacaguggcgucaaguuugguccucgugguuagccugggagcaauuuccuuuuggaugugcucuaacgguucguuacaaugcaggaucuguaucuga

SEQ ID NO: 126567 - RNA, 1701 nt, Artificial Sequence; identical to SEQ ID NO: 124927
  derived and/or modified sequence opt3 from hemagglutinin__InfluenzaA__ADF27374

SEQ ID NO: 126568 - RNA, 1701 nt, Artificial Sequence
  derived and/or modified sequence opt3 from hemagglutinin__InfluenzaA__ADF27375
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucaaaagucuacacagaacgccauugacgagaucaccaauaaaauaaacagcgugauugaaaagaugaauacgcaguuuaccgcuguugguaaagaguucaaccaucucgaaaagcggaucgagaaucugaacaagaaaguggaugacggguucuuagauaucuggacauacaaugccgaacugcucguccuucuggagaacgagcgcacuuuggacuaucacgauucaaaugugaagaaccuauacgaaaaaguacgaagucagcugaagaacaaugcaaaagagauuggcaacggauguuuugaguucuaucauaagugcgacaauaccuguauggaauccguuaagaacggcacauacgauuauccuaaauacagcgaagaggccaagcucaauagagaggaaaucgacggggugaaacuggagucuacuaggauuuaucaaauacuugcuaucuacucaaccgucgcgaguagccugguguuggucgugucccucggagcaauuucuuuuuggaugugcucgaacgguagccugcagugccggaucuguaucuga

SEQ ID NO: 126569 - RNA, 1701 nt, Artificial Sequence
  derived and/or modified sequence opt3 from hemagglutinin__InfluenzaA__ADF27376
augaaggccauccuggugguccuccuuuacaccuucguuacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuaacucggacaauggaacuugcuauccaggcgauuuuaucgacuacgaagaacucagggagcagcugucaagcgucaguuccuucgaacgguuugagauuuucccgaagacaucuagcuggcccaaccacgauuccaauaagggugugaccgcagccuguccucaugcuggggcaaaaucauuuuauaagaaccugaucuggcucguuaaaaagggaaauaguuacccaaaauuaagcaagucuuauauaaacgacaagggcaaagaaguacuggugcuuuggggcauccaccaccccuccacgucagccgaucaacagagcuuguaccagaaugcugacgccuacgucuucguggggaccagucgcuauucuaagaaauuuaagccugagauugagauccgaccaaaagugcgugaucaggaaggaagaaugaacuacuauuggacucuggucgagcccggugacaagauuacauucgaagcgacuggcaaccuaguugugccuagguacgcauuugccauggagcggaaugcuggguccggaaucauaauuagcgauaccccaguacaugacugcaacacaaccugucaaacgccgaaaggcgccaucaauacuucgcuccccuuccagaacauucacccuaucacaaucgguaagugcccaaaguaugugaaaucuaccaagcugcgccuugcaacugggcugagaaauguccccuccauucagucaaggggauuguuuggcgcuauagccggcuucaucgaagggggauggacagguaugguggacggcugguacggguaucaucaccagaacgagcaaggaaguggcuacgcggccgaucucaaaagcacccagaaugcaauugacaagaucacgaacaaaguuaauuccgugauagagaagaugaacacccaguuuacagcugucgguaaggaguucaaucaccuggagaaacggauugaaaacuuaaauaagaaaguggaugacggguuccuggauaucuggacuuacaacgccgagcuccuuguacuguuggaaaaugagcgcacccuagacuaucaugauucuaacguuaagaaccuguacgagaaagugcgaagccagcucaagaauaacgcuaaggaaaucggcaauggauguuuugaguucuaucacaaaugcgacaacacauguauggaaucagucaagaauggcacuuacgauuauccuaaauacagugaggaagccaagcugaacagagaggagauugacggggugaaacuugaauccaccaggaucuaucaaauucuggcaauauacagcacagucgccucuucauuggugcucguugugagucugggagcuaucagcuuuuggaugugcuccaaugguucuuuacagugccggauuuguaucuga

SEQ ID NO: 126570 - RNA, 1701 nt, Artificial Sequence
  derived and/or modified sequence opt3 from hemagglutinin__InfluenzaA__ADF27378
augaaggccauccuggugguccuccuuuacaccuucguuacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuaacucggacaauggaacuugcuauccaggcgauuuuaucgacuacgaggagcucagggagcagcugucaagcgucaguuccuucgaacgguuugagauuuucccgaagacaucuagcuggcccaaccacgauuccaauaagggugugaccgcagccuguccucaugcuggggcaaaaucauuuuauaagaaccugaucuggcucguuaaaaagggaaauaguuacccaaaauuaagcaagucuuauauaaacgacaagggcaaagaaguacuggugcuuuggggcauccaccaccccuccacgucagccgaucaacagagcuuguaccagaaugcugacgccuacgucuucguggggaccagucgcuauucuaagaaauuuaagccugagauugcgauccgaccaaaagugcgugaucaggagggaagaaugaacuacuauuggacucuggucgaacccggugacaagauuacauucgaggcaacuggcaaccuaguugugccuagguacgccuuugcuauggaacggaaugccggguccggaaucauaauuagcgauaccccaguacaugacugcaacacaaccugucaaacgccgaaaggcgcaaucaauacuucgcuccccuuccagaacauucacccuaucacaaucgguaagugcccaaaguaugugaaaucuaccaagcugcgccuugcuacugggcugagaaauguccccuccauucagucaaggggauuguuuggcgccauagcgggcuucaucgaagggggauggacagguaugguggacggcugguacggguaucaucaccagaacgaacaaggaaguggcuacgccgcagaucucaaaagcacccagaaugcuauugacaagaucacgaacaaaguuaauuccgugauagagaagaugaacacccaguuuacagccgucgguaaggaguucaaucaccuggaaaaacggauugagaacuuaaauaagaaaguggaugacggguuccuggauaucuggacuuacaacgcugaacuccuuguacuguuggagaaugaacgcacccuagacuaucaugauucuaacguuaagaaccuguacgagaaagugcgaagccagcucaagaauaacgccaaggagaucggcaauggauguuuugaguucuaucacaaaugcgacaacacauguauggaaucagucaagaauggcacuuacgauuauccuaaauacagugaagaggcaaagcugaacagagaagagauugacggggugaaacuugaguccaccaggaucuaucaaauucuggccauauacagcacagucgcuucuucauuggugcucguugugagucugggagcgaucagcuuuuggaugugcuccaaugguucuuuacagugccggauuuguaucuga

SEQ ID NO: 126571 - RNA, 1701 nt, Artificial Sequence
  derived and/or modified sequence opt3 from hemagglutinin__InfluenzaA__ADF27389
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaaccucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 126572 - RNA, 1701 nt, Artificial Sequence
  derived and/or modified sequence opt3 from hemagglutinin__InfluenzaA__ADF27399
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucggugagugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126573 - RNA, 1701 nt, Artificial Sequence; identical to SEQ ID NO: 125849
  derived and/or modified sequence opt3 from hemagglutinin__InfluenzaA__ADF27409

SEQ ID NO: 126574 - RNA, 1701 nt, Artificial Sequence; identical to SEQ ID NO: 126557
  derived and/or modified sequence opt3 from hemagglutinin__InfluenzaA__ADF27419

SEQ ID NO: 126575 - RNA, 1701 nt, Artificial Sequence
  derived and/or modified sequence opt3 from hemagglutinin__InfluenzaA__ADF27429
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguucuauauaaaugacaagggcaaagaaguacugguucuuuggggcauccaccaccccuccacgucagcugaucaacagagcuuguaccagaacgccgacgcguacguguuugucgggaccagucgcuauucuaagaaauucaagccugagauugcaauccgaccaaaagugcgugaucaggagggaagaaugaauuacuauuggacucugguggaacccggugacaagauuacauuugaggccacuggcaaccuagucguuccuagguacgcuuucgccauggaacggaacgcaggguccggaaucauaauuagcgauaccccagugcaugacugcaauacaaccugucaaacgccgaaaggcgcuaucaacacuucgcuccccuuucagaauauucacccuaucacaaucgguaagugcccaaaguauguaaaaucuaccaagcugcgccuugccacugggcugagaaacgugcccuccauucagucaaggggauuguucggcgcgauagccggcuuuaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguucacagcuguggguaaggaguucaaccaccuggaaaaacggauugagaauuuaaacaagaaagucgaugacggguuucuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuucgaauuuuaucacaaaugcgacaauacauguaugaagucagugaaaaacggcacuuacgauuauccuaaguacagugaggaagccaaacugaauagagaggaaauugacggggucaaacuugaguccaccaggaucuaucaaauucuggcuauauacagcacaguggcgucuucauugguccucgugguuagucugggagcaaucagcuucuggaugugcuccaacgguucuuuacagugccggauuuguaucuga

SEQ ID NO: 126576 - RNA, 1701 nt, Artificial Sequence; identical to SEQ ID NO: 124685
  derived and/or modified sequence opt3 from hemagglutinin__InfluenzaA__ADF27439

SEQ ID NO: 126577 - RNA, 1701 nt, Artificial Sequence
  derived and/or modified sequence opt3 from hemagglutinin__InfluenzaA__ADF27449
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacauucccucaauacagaguaggggauuguuuggcgccaucgcgggcuucauugaagggggauggacagguauggucgacggcugguacggguaucaucaccagaaugaacaaggaagcggcuacgccgcagaucucaaauccacccagaacgcuaucgacgagauaacgaauaaggugaacucuguuauugagaaaaugaauacccaguuuacagccguggguaaggaguucaaccaccuggaaaagcggaucgaaaauuuaaacaaaaaggucgaugacggguuccuggauaucuggacuuacaaugcugagcuccuugugcuguuggaaaacgagcgcacccuagacuaucaugauagcaauguuaaaaaccuguacgagaagguacgaucacagcucaaaaacaaugccaaggaaauuggcaacggauguuuugaguucuaucacaagugcgacaauacauguauggaaagugugaaaaacggcacuuacgauuauccuaaguacuccgaggaagcaaaacugaauagagaggagaucgacggggucaaacuugaaagcaccaggauuuaucaaauacuggccaucuacucuacaguggcuucaaguuugguccucgugguuagccugggagcgauuuccuuuuggaugugcucuaacgguucguuacagugccggaucuguaucuga

SEQ ID NO: 126578 - RNA, 1701 nt, Artificial Sequence; identical to SEQ ID NO: 125845
  derived and/or modified sequence opt3 from hemagglutinin__InfluenzaA__ADF27459

SEQ ID NO: 126579 - RNA, 1701 nt, Artificial Sequence; identical to SEQ ID NO: 124685
  derived and/or modified sequence opt3 from hemagglutinin__InfluenzaA__ADF27469

SEQ ID NO: 126580 - RNA, 1701 nt, Artificial Sequence
  derived and/or modified sequence opt3 from hemagglutinin__InfluenzaA__ADF27479
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucauaguaggggauuguuuggcgcgauagccggcuucaucgaagggggauggacagguauggucgacggcugguacggguaucaccaccagaaugaacagggaagcggcuacgcagcugaucucaaauccacccaaaacgccauugacaagaucacgaauaaagugaacucuguuauagagaagaugaauacccaguuuacagcuguggguaaggaguucaaccaucuggaaaaacggauugagaauuuaaacaagaaagucgaugacggguuccuggauaucuggacuuacaaugccgaacuccuugugcuguuggagaacgaacgcacccuagacuaucacgauagcaauguaaagaaccuguacgagaaaguucgaucacagcucaagaacaaugcaaaggagaucggcaacggauguuuugaguucuaucauaaaugcgacaauacauguauggaaagugugaagaacggcacuuacgauuauccuaaauacuccgaagaggccaagcugaauagagaagagauugacggggucaaacuugagagcaccaggaucuaucagauucuggcuauauacucuacaguggcgucaaguuugguccucgugguuagccugggagcaaucuccuuuuggaugugcucuaacgguucguuacaaugccggauuuguaucuga

SEQ ID NO: 126581 - RNA, 1701 nt, Artificial Sequence
  derived and/or modified sequence opt3 from hemagglutinin__InfluenzaA__ADF27489
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaauacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuucgucagauaacggaacuugcuacccaggcgacuuuaucgauuaugaagaacucagggagcagcugagcaguguguccucuuucgaacgguuugagauuuucccgaagacaagcuccuggcccaaucacgacucaaacaagggugucaccgccgcuuguccucaugcaggggccaaaaguuuuuacaagaaucugaucuggcucgugaaaaagggaaacagcuauccaaaauuaucuaaguccuacauaaaugauaagggcaaagaaguacugguucuuuggggcauccaccaccccucaacgagcgcugaccaacagaguuuguaccagaacgccgaugcguauguguucgucgggacuucucgcuacuccaagaaauuuaagccugagauugcaauccgaccaaaagugcgugaccaggagggaagaaugaauuauuacuggacccugguggaacccggugauaagauuacauucgaggccacuggcaaccuagucguuccuagguaugcuuuugccauggaacggaacgcagggagcggaaucauaauuucggacaccccagugcaugauugcaauacaaccugucaaacgccgaaaggcgcuaucaacacuucucuccccuuccagaauauucacccuaucacaaucggugagugcccaaaguacguaaaguccaccaaacugcgccuugccacugggcugagaaacgugcccucaauucagaguaggggauuguuuggcgcgauagccggcuucaucgaagggggauggacagguauggucgacggcugguauggguaccaucaccagaaugagcaaggaagcggcuacgcagcugaccucaaguccacccagaacgccauugaugagaucacgaauaaagugaacucuguuauagaaaagaugaauacccaguuuacagcuguggguaaagaguucaaccaccuggaaaagcggauugagaauuuaaacaagaaagucgacgauggguuccuggacaucuggacuuauaaugccgaacuccuugugcuguuggagaacgagcgcacccuagauuaccaugacagcaauguaaagaaccuguaugaaaaaguucgaucacagcucaagaacaaugcaaaagagaucggcaacggauguuuugaguucuaccacaagugcgauaauacauguauggagagugugaagaacggcacuuaugacuacccuaaauauuccgaagaggccaagcugaauagagaggaaauugauggggucaaacuugagagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 126582 - RNA, 1701 nt, Artificial Sequence; identical to SEQ ID NO: 125849
  derived and/or modified sequence opt3 from hemagglutinin__InfluenzaA__ADF27499

SEQ ID NO: 126583 - RNA, 1701 nt, Artificial Sequence; identical to SEQ ID NO: 124685
  derived and/or modified sequence opt3 from hemagglutinin__InfluenzaA__ADF27509

SEQ ID NO: 126584 - RNA, 1701 nt, Artificial Sequence; identical to SEQ ID NO: 126282
  derived and/or modified sequence opt3 from hemagglutinin__InfluenzaA__ADF27529

SEQ ID NO: 126585 - RNA, 1701 nt, Artificial Sequence; identical to SEQ ID NO: 125857
  derived and/or modified sequence opt3 from hemagglutinin__InfluenzaA__ADF27539

SEQ ID NO: 126586 - RNA, 1701 nt, Artificial Sequence; identical to SEQ ID NO: 125857
  derived and/or modified sequence opt3 from hemagglutinin__InfluenzaA__ADF27549

SEQ ID NO: 126587 - RNA, 1701 nt, Artificial Sequence; identical to SEQ ID NO: 124685
  derived and/or modified sequence opt3 from hemagglutinin__InfluenzaA__ADF27559

SEQ ID NO: 126588 - RNA, 1701 nt, Artificial Sequence
  derived and/or modified sequence opt3 from hemagglutinin__InfluenzaA__ADF27569
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagagugaauuacuauuggacccuggucgaacccggugacaagauuacauucgaggccacuggcaaccuaguugugccuagguacgcuuuugccauggaacggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugaacaaggaagcggcuacgcagcugaucucaaauccacccagaacgccauugacaagaucacgaauaaaguuaacucugugauagagaagaugaauacccaguuuacagcugucgguaaggaguucaaccaccuggaaaaacggauugagaauuuaaacaagaaaguggaugacggguuccuggauaucuggacuuacaaugccgaacuccuuguacuguuggagaacgaacgcacccuagacuaucaugauagcaauguuaagaaccuguacgagaaagugcgaucacagcucaagaacaaugcaaaggagaucggcaacggauguuuugaguucuaucacaaaugcgacaauacauguauggaaagugucaagaacggcacuuacgauuauccuaaauacuccgaagaggccaagcugaauagagaagagauugacggggugaaacuugagagcaccaggaucuaucaaauucuggcuauauacucuacagucgcgucaaguuuggugcucguugugagccugggagcaaucuccuuuuggaugugcucuaacgguucguuacagugccggauuuguaucuga

SEQ ID NO: 126589 - RNA, 1701 nt, Artificial Sequence; identical to SEQ ID NO: 125857
  derived and/or modified sequence opt3 from hemagglutinin__InfluenzaA__ADF27579

SEQ ID NO: 126590 - RNA, 1701 nt, Artificial Sequence
  derived and/or modified sequence opt3 from hemagglutinin__InfluenzaA__ADF27589
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccucugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 126591 - RNA, 1701 nt, Artificial Sequence
  derived and/or modified sequence opt3 from hemagglutinin__InfluenzaA__ADF27599
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuuaccauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaguaacgccaaggaaaucggcaauggauguuuugaguucuaucacaagugcgacaacacuuguauggaauccgugaaaaauggcaccuacgauuauccuaaguacagcgaggaagcaaaacugaacagagaggagauugacggggucaaacuugaaucuacaaggaucuaucaaauucuggccauauacucaaccguggcuaguagcuugguccucgugguuucccugggagcgaucucuuuuuggaugugcucgaaugguagcuuacagugccggauuuguaucuga

SEQ ID NO: 126592 - RNA, 1701 nt, Artificial Sequence
  derived and/or modified sequence opt3 from hemagglutinin__InfluenzaA__ADF27609
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaagcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucagcagaguuuguaccagaacgccgacgcguacguguucgucgggacuucucgcuauuccaagaaauuuaagccugagauugcaauccgaccaaaagugcgugaucaagagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcacgacugcaauacaaccugucagacgccgaaaggcgcuaucaacacuucucuccccuuccagaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaucaaaaugaacagggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucacgauagcaauguaaagaaccuguacgagaagguucgaucacaacucaaaaacaaugcaaaggaaaucggcaacggauguuuugaguucuaucauaagugcgacaauacauguauggaaagugugaaaaacggcacuuacgauuauccuaaguacuccgaggaagccaaacugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 126593 - RNA, 1701 nt, Artificial Sequence
  derived and/or modified sequence opt3 from hemagglutinin__InfluenzaA__ADF27619
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugguuccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagggcaaagaaguacuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacaagaucacgaauaaaguuaacucugugauagagaagaugaauacccaguuuacagccgucgguaaggaguucaaccaccuggaaaaacggauugagaauuuaaacaagaaaguggaugacggguuccuggauaucuggacuuacaaugcugaacuccuuguacuguuggagaacgaacgcacccuagacuaucaugauagcaauguuaagaaccuguacgagaaagugcgaucacagcucaagaacaaugccaaggagaucggcaacggauguuuugaguucuaucacaaaugcgacaauacauguauggaaagugucaagaacggcacuuacgauuauccuaaauacuccgaagaggcaaagcugaauagagaagagauugacggggugaaacuugagagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 126594 - RNA, 1701 nt, Artificial Sequence; identical to SEQ ID NO: 125857
  derived and/or modified sequence opt3 from hemagglutinin__InfluenzaA__ADF27629

SEQ ID NO: 126595 - RNA, 1701 nt, Artificial Sequence
  derived and/or modified sequence opt3 from hemagglutinin__InfluenzaA__ADF27649
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagccuaggggauuguuuggcgcgauagccggcuucaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggaaucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 126596 - RNA, 1701 nt, Artificial Sequence; identical to SEQ ID NO: 125857
  derived and/or modified sequence opt3 from hemagglutinin__InfluenzaA__ADF27659

SEQ ID NO: 126597 - RNA, 1701 nt, Artificial Sequence; identical to SEQ ID NO: 126334
  derived and/or modified sequence opt3 from hemagglutinin__InfluenzaA__ADF27669

SEQ ID NO: 126598 - RNA, 1701 nt, Artificial Sequence; identical to SEQ ID NO: 125786
  derived and/or modified sequence opt3 from hemagglutinin__InfluenzaA__ADF27679

SEQ ID NO: 126599 - RNA, 1701 nt, Artificial Sequence; identical to SEQ ID NO: 126395
  derived and/or modified sequence opt3 from hemagglutinin__InfluenzaA__ADF27689

SEQ ID NO: 126600 - RNA, 1701 nt, Artificial Sequence
  derived and/or modified sequence opt3 from hemagglutinin__InfluenzaA__ADF27699
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcauaauugcaacacaaccugucaaacgccgaaaggcgcuauuaauacuucucuccccuuccagaacauccacccuauuacaaucgguaagugcccaaaguauguaaaauccaccaagcugcgccuugccacugggcugagaaaugugcccucaauccagaguaggggauuguuuggcgcgauugccggcuucauagaagggggauggacagguauggucgacggcugguacggguaucaucaccagaacgaacaaggaagcggcuacgcagcugaccucaaauccacccagaaugccaucgaugagauuacgaacaagguaaauucuguuaucgagaaaaugaacacccaguuuacagcuguggguaaggaguucaaucaccuggaaaagcggauagaaaacuuaaauaaaaaggucgacgauggguuccuggacauuuggacuuacaacgccgagcuccuugugcuguuggaaaaugagcgcacccuagauuaucaugacagcaacgugaaaaaccuguacgagaagguucgaucacagcucaaaaauaacgcaaaggaagugggcaauggauguuuugaguucuaucacaagugcgauaacacauguauggaaagugucaaaaauggcacuuacgacuauccuaaguacuccgaggaagccaaacugaacagagaggagaucgauggggugaaacuugaaagcaccaggaucuaucaaauucuggcuaucuacucuacagucgcgucaaguuuggugcucguugugagccugggagcaauuuccuuuuggaugugcucuaaugguucguuacagugccggauauguaucuga

SEQ ID NO: 126601 - RNA, 1701 nt, Artificial Sequence
  derived and/or modified sequence opt3 from hemagglutinin__InfluenzaA__ADF27709
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaucucuucgucagacaacggaaccugcuauccaggcgauuuuauuaauuacgaggagcucagggagcagcugagcaguguguccucuuucgaacgguuugagaucuucccgaagacuagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccagcgcugaccaacagaguuuguaccagaaugccgaugcguacguguucgucgggacgucucgcuauuccaagaaauuuaagccugagaucgcaauucgaccaaaagugcgugaccaggagggaagaaugaacuacuauuggacucugguggaacccggugauaagaucaccuucgaggccacaggcaaccuagucguuccuagguacgcuuuugccauggaacggaaugcagggagcggaauaauuaucucggacacuccagugcaugauugcaacaccacaugucaaaccccgaaaggcgcuauuaauacgucucuccccuuccagaacauccacccuaucacuauugguaagugcccaaaguauguaaaauccacaaagcugcgccuugccaccgggcugagaaaugugcccucaauacagaguaggggauuguuuggcgcgaucgccggcuucauugaagggggauggacugguauggucgacggcugguacggguaucaucaccagaacgaacaaggaagcggcuacgcagcugaccucaaauccacacagaaugccaucgauaagauaaccaacaaaguuaauucugugauugagaagaugaacacgcaguuuaccgcuguggguaaggaguucaaucaccuggaaaaacggaucgagaacuuaaauaagaaagucgacgauggguuccuggacaucuggacauacaacgccgaacuccuugugcuguuggagaaugaacgcacucuagauuaucaugacagcaacguaaagaaccuguacgagaaaguucgaucacagcucaagaauaacgcaaaggagauuggcaauggauguuuugaguucuaucacaaaugcgauaacaccuguauggaaagugugaagaauggcacauacgacuauccuaaauacuccgaagaggccaagcugaacagagaagagaucgauggggucaaacuugagagcacuaggauuuaucaaauacuggcuaucuacucuaccguggcgucaaguuugguccucgugguuagccugggagcaauuuccuuuuggaugugcucuaaugguucguuacagugccggaucuguaucuga

SEQ ID NO: 126602 - RNA, 1701 nt, Artificial Sequence; identical to SEQ ID NO: 125849
  derived and/or modified sequence opt3 from hemagglutinin__InfluenzaA__ADF27785

SEQ ID NO: 126603 - RNA, 1701 nt, Artificial Sequence
  derived and/or modified sequence opt3 from hemagglutinin__InfluenzaA__ADF27795
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggugaagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggagagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126604 - RNA, 1701 nt, Artificial Sequence; identical to SEQ ID NO: 125857
  derived and/or modified sequence opt3 from hemagglutinin__InfluenzaA__ADF27805

SEQ ID NO: 126605 - RNA, 1701 nt, Artificial Sequence
  derived and/or modified sequence opt3 from hemagglutinin__InfluenzaA__ADF27815
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugacggggcaaaaaguuuuuauaagaaucugaucuggcucgugaaaaagggaaacagcuacccaaaauuaucuaaguccuauauaaaugauaagggcaaagaaguacugguucuuuggggcauccaccaccccucaacgagcgccgaccaacagaguuuguaccagaacgcugaugccuacguguucgucgggacuucucgcuauuccaagaaauuuaagccugagauugcgauccgaccaaaagugcgugaccaggagggaagaaugaauuacuauuggacccugguggaacccggugauaagauuacauucgaggcaacuggcaaccuagucguuccuagguacgccuuugcuauggaacggaacgccgggagcggaaucauaauuucggacaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgauggcugguacggguaucaucaccagaaugaacaaggaagcggcuacgccgcagaccucaaauccacccagaacgcuauugauaagaucacgaauaaagugaacucuguuauagagaagaugaauacccaguuuacagccguggguaaggaguucaaccaccuggaaaaacggauugagaauuuaaacaagaaagucgacgauggguuccuggacaucuggacuuacaaugcugaacuccuugugcuguuggagaacgaacgcacccuagauuaucaugacagcaauguaaagaaccuguacgagaaaguucgaucacagcucaagaacaaugccaaggagaucggcaacggauguuuugaguucuaucacaaaugcgauaauacauguauggaaagugugaagaacggcacuuacgacuauccuaaauacuccgaagaggcaaagcugaauagagaagagauugauggggucaaacuugagagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 126606 - RNA, 1701 nt, Artificial Sequence
  derived and/or modified sequence opt3 from hemagglutinin__InfluenzaA__ADF27825
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacagcgaggagcuccgggagcagcugaguuccgugucuagcuucgaacgcuuugagauuuucccgaaaacauccucauggcccaaucacgauaguaacaagggugucaccgccgcuuguccucaugcaggggccaagagcuuuuacaaaaaucugaucuggcucgugaagaaaggaaacucuuauccaaaguuauccaaaucauacauaaaugacaagggcaaggaaguacugguucuuuggggcauccaccaccccagcacgagugcugaucaacagucuuuguaucagaacgccgacgcguacguguucgucgggacuucccgauacagcaaaaaguuuaaaccugagauugcaauccguccaaaggugagagaucaggagggaaggaugaauuauuacuggacccugguggaacccggugacaaaauuacauucgaggccacuggcaaccuagucguuccucgguaugcuuuugccauggaacgcaacgcagggucgggaaucauaauuucugauaccccagugcaugacugcaauacaaccugucaaacgccgaagggcgcuaucaacacuucccuccccuuccagaauauucacccuaucacaaucgguaaaugcccaaaguacguaaagucaaccaaacugagacuugccacugggcugaggaacgugcccaguauucagagccggggauuguuuggcgcgauagccggcuucaucgaagggggauggacagguauggucgacggcugguauggguaccaucaccagaaugaacaaggauccggcuaugcagcugaucucaagucuacccagaacgccauugacgagaucacgaauaaagugaacagcguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaccaugauucaaauguaaagaaccuguaugagaaaguuagaagucagcucaagaacaaugcaaaagaaaucggcaacggauguuuugaguucuaccacaagugcgacaauacauguauggaauccgugaagaacggcacuuaugauuacccuaaauauagcgaggaagccaagcugaauagggaggagauugacggggucaaacuugaaucuacccggaucuaccaaauucuggcuauauauucaacaguggcgaguagcuugguccucgugguuucccugggagcaaucucuuuuuggaugugcucgaacgguagcuuacagugccguauuuguaucuga

SEQ ID NO: 126607 - RNA, 1701 nt, Artificial Sequence
  derived and/or modified sequence opt3 from hemagglutinin__InfluenzaA__ADF27845
augaaggccauccuggugguccuccuuuacaccuucgcuacagcaaacgccgacacucugugcauuggcuaucacgcgaauaacagcacggauaccguugacacaguguuggagaagaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgaacgccgaucaacagagcuuguaccagaaugcggacgcauacguuuucguggggaccagucgcuauucuaagaaauuuaagccugagauugccauccgaccaaaaguccgugaucaggagggaagaaugaacuacuauuggacucugguggaacccggugacaagauuacauucgaggcuacuggcaaccuaguggucccuagguacgccuuugcaauggaacggaaugcuggguccggaaucauaauuagcgauaccccaguucaugacugcaacacaaccugucaaacgccgaaaggcgccaucaauacuucgcuccccuuccagaacauucacccuaucacaaucgguaagugcccaaaguaugugaaaucuaccaagcugcgccuugcgacugggcugagaaauguacccuccauucagucaaggggauuguuuggcgccauagcaggcuucaucgaagggggauggacagguaugguggacggcugguacggguaucaucaccagaacgaacaaggaaguggcuacgcugccgaucucaaaagcacccagaaugcuauugacgagaucacgaacaaggucaauuccgugauagagaaaaugaacacccaguuuacagccguugguaaggaguucaaucaccuggaaaagcggauugaaaacuuaaauaaaaagguggaugacggguuccuggauaucuggacuuacaacgcagagcuccuuguccuguuggaaaaugagcgcacccuagacuaucaugauucuaacgugaaaaaccuguacgagaagguacgaagccagcucaaaaauaacgccaaggaaaucggcaauggauguuuugaguucuaucacaagugcgacaacacauguauggaaucaguuaaaaauggcacuuacgauuauccuaaguacagugaggaagcuaaacugaacagagaggagauugacggggugaaacuugaauccaccaggaucuaucaaauucuggcgauauacagcacagucgcaucuucauuggugcucgucgugagucugggagccaucagcuuuuggaugugcuccaaugguucuuuacagugccggauuuguaucuga

SEQ ID NO: 126608 - RNA, 1701 nt, Artificial Sequence; identical to SEQ ID NO: 125849
  derived and/or modified sequence opt3 from hemagglutinin__InfluenzaA__ADF27855

SEQ ID NO: 126609 - RNA, 1701 nt, Artificial Sequence; identical to SEQ ID NO: 125849
  derived and/or modified sequence opt3 from hemagglutinin__InfluenzaA__ADF27865

SEQ ID NO: 126610 - RNA, 1701 nt, Artificial Sequence; identical to SEQ ID NO: 125849
  derived and/or modified sequence opt3 from hemagglutinin__InfluenzaA__ADF27875

SEQ ID NO: 126611 - RNA, 1701 nt, Artificial Sequence; identical to SEQ ID NO: 125849
  derived and/or modified sequence opt3 from hemagglutinin__InfluenzaA__ADF27885

SEQ ID NO: 126612 - RNA, 1701 nt, Artificial Sequence; identical to SEQ ID NO: 124685
  derived and/or modified sequence opt3 from hemagglutinin__InfluenzaA__ADF27895

SEQ ID NO: 126613 - RNA, 1701 nt, Artificial Sequence
  derived and/or modified sequence opt3 from hemagglutinin__InfluenzaA__ADF27915
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucagcuagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacaagaucaccaauaaagugaacucuguuauagagaagaugaauacgcaguuuaccgccguggguaaggaguucaaccaccuggaaaaacggauugagaauuuaaacaagaaagucgaugacggguuccuggauaucuggacauacaaugcagaacuccuugugcuguuggagaacgaacgcacucuagacuaucaugauagcaauguaaagaaccuguacgagaaaguucgaucacagcucaagaacaaugccaaggagaucggcaacggauguuuugaguucuaucacaaaugcgacaauaccuguauggaaagugugaagaacggcacauacgauuauccuaaauacuccgaagaggcuaagcugaauagagaagagauugacggggucaaacuugagagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 126614 - RNA, 1701 nt, Artificial Sequence
  derived and/or modified sequence opt3 from hemagglutinin__InfluenzaA__ADF27925
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaauuccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagcucaugacugcaacacaaccugucaaacgccgaagggcgccaucaauacuucucuccccuuccagaacauucacccuaucacaaucgguaaaugcccaaaguaugugaaguccaccaaacugcgcauggcgacugggcuuagaaauguacccucaauucagaguaggggacuguuuggcgccauagcaggcuucaucgaagggggauggacagguaugguggacggcugguacggguaucaucaccagaacgaacaaggaagcggcuacgcugccgauuugaaguccacccagaaugcuauugacgagaucacgaacaaagucaauucugugauagagaagaugaacacccaguuuacagccguugguaaagaguucaaucaccucgaaaagcggauugaaaaccugaauaagaaaguggaugacggguucuuagauaucuggacuuacaacgcagagcugcucguccuucuggaaaaugagcgcaccuuggacuaucaugauagcaacgugaagaaccuauacgagaaaguacgaucacagcugaagaauaacgccaaagaaaucggcaauggauguuuugaguucuaucacaagugcgacaacacauguauggaaaguguuaagaauggcacuuacgauuauccuaaauacuccgaggaagcuaagcucaacagagaggagauugacggggugaaacuggaaagcaccaggaucuaucaaauucuugcgauauacucuacagucgcaucaagucugguguuggucgugagccucggagccaucuccuuuuggaugugcucuaaugguucgcugcagugccggauuuguaucuga

SEQ ID NO: 126615 - RNA, 1701 nt, Artificial Sequence
  derived and/or modified sequence opt3 from hemagglutinin__InfluenzaA__ADF27935
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccuaagugugagucuuugucaacagaaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaaaggugucaccgcagccuguccucaugcuggggcaaagaguuuuuauaaaaaccugaucuggcucgugaagaaaggaaauagcuacccaaaguuaucuaaguccuauauaaacgauaaaggcaaggaaguacugguucuuuggggcauccaccaccccucaacgagcgccgaccaacagaguuuguaccagaaugcugaugccuacguguucgucgggacuucucgcuauuccaaaaaguuuaaaccugagauugcgauccgaccaaaggugcgugaccaggagggaagaaugaacuacuauuggacccugguggaacccggugauaaaauuacauucgaggcaacuggcaaccuagucguuccuagguacgccuuugcuauggaacggaaugccgggagcggaaucauaauuucggacaccccagugcaugauugcaacacaaccugucaaacgccgaagggcgcaaucaauacuucucuccccuuccagaacauucacccuaucacaaucgguaagugcccaaaauauguaaaguccaccaaacugcgccuugcuacugggcugagaaaugugcccucaauucagaguaggggauuguuuggcgccauagcgggcuucaucgaagggggauggacagguauggucgacggcugguacggguaucaucaccagaacgaacaaggaagcggcuacgccgcagaccucaaguccacccagaaugcuauugauaaaaucacgaacaagguaaauucuguuauagagaagaugaacacccaguuuacagccguggguaaagaguucaaucaccuggaaaagcggauugagaacuuaaauaaaaaggucgacgauggguuccuggacaucuggacuuacaacgcugaacuccuugugcuguuggagaaugaacgcacccuagauuaucaugacagcaacgugaaaaaccuguacgagaagguucgaucacagcucaagaauaacgccaaagagaucggcaauggauguuuugaguucuaucacaagugcgauaacacauguauggaaagugugaaaaauggcacuuacgacuauccuaaguacuccgaagaggcaaaacugaacagagaagagauugauggggucaaacuugagagcaccaggaucuaucaaauucuggccauauacucuacaguggcuucaaguuugguccucgugguuagccugggagcgaucuccuuuuggaugugcucuaaugguucguuacagugccggauuuguaucuga

SEQ ID NO: 126616 - RNA, 1701 nt, Artificial Sequence
  derived and/or modified sequence opt3 from hemagglutinin__InfluenzaA__ADF27955
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaauuccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguaaauucuguuauagagaaaaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaccuguacgagaagguucgaucacagcucaaaaauaacgcaaaggagaucggcaauggauguuuugaguucuaucacaagugcgacaacacauguauggaaagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126617 - RNA, 1701 nt, Artificial Sequence
  derived and/or modified sequence opt3 from hemagglutinin__InfluenzaA__ADF27965
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaaaagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugaaugacugcaacacaaccugucaaacgccgaagggcgcuaucaauacuucucuccccuuccagaacauucauccuaucacaaucgguaagugcccaaaauauguaaaguccaccaaacugcgccuugccacugggcugagaaaugugcccucaauucagaguaggggauuguuuggcgcgauagccggcuucaucgaagggggauggacagguauggucgacggcugguacggguaucaccaucagaacgagcaaggaagcggcuacgcagcugaucucaaguccacccagaaugccauugacaaaaucacgaacaagguaaauucuguuauagaaaagaugaacacccaguuuacagcuguggguaaagaguucaaucaccuggagaagcggauugaaaacuuaaauaaaaaggucgaugacggguuccuggauaucuggacuuacaacgccgagcuccuugugcuguuggaaaaugagcgcacccuagacuaucacgauagcaacgugaaaaaccuguacgaaaagguucgaucacagcucaagaauaacgcaaaagagaucggcaauggauguuuugaguucuaucauaagugcgacaacacauguauggaaagugugaaaaauggcacuuacgauuauccuaaguacuccgaggaagccaaacugaacagagaggaaauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126618 - RNA, 1701 nt, Artificial Sequence; identical to SEQ ID NO: 125849
  derived and/or modified sequence opt3 from hemagglutinin__InfluenzaA__ADF27975

SEQ ID NO: 126619 - RNA, 1701 nt, Artificial Sequence; identical to SEQ ID NO: 125857
  derived and/or modified sequence opt3 from hemagglutinin__InfluenzaA__ADF27985

SEQ ID NO: 126620 - RNA, 1701 nt, Artificial Sequence
  derived and/or modified sequence opt3 from hemagglutinin__InfluenzaA__ADF27995
augaaggccauccuggugguccuccuuuacaccuucgcuacagcaaacgccgacacucugugcauuggcuaucacgcgaauaacagcacggauaccguugacacaguguuggagaagaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgaacgccgaucaacagagcuuguaccagaaugcggacgcauacguuuucguggggaccagucgcuauucuaagaaauuuaagccugagauugccauccgaccaaaaguccgugaucaggagggaagaaugaacuacuauuggacucugguggaacccggugacaagauuacauucgaggcuacuggcaaccuaguggucccuagguacgccuuugcaauggaacggaaugcuggguccggaaucauaauuagcgauaccccagcccaugacugcaacacaaccugucaaacgccgaaaggcgcgaucaauacuucgcuccccuuccagaacauucacccuaucacaaucgguaagugcccaaaguauguuaaaucuaccaagcugcgccuugccacugggcugagaaauauucccuccauacagucaaggggauuguuuggcgcaaucgcuggcuucauugaagggggauggacagguaugguggacggcugguacggguaucaucaccagaacgaacaaggaaguggcuacgccgcugaucucaaaagcacccagaaugccaucgacgagauaacgaacaagguaaauuccgugauugagaaaaugaacacccaguuuacagcagucgguaaggaguucaaucaccuggaaaagcggaucgaaaacuuaaauaaaaagguggaugacggguuccuggauaucuggacuuacaacgccgagcuccuuguucuguuggaaaaugagcgcacccuagacuaucaugauucuaacgugaaaaaccuguacgagaagguccgaagccagcucaaaaauaacgcuaaggaaauuggcaauggauguuuugaguucuaucacaagugcgacaacacauguauggaaucagugaaaaauggcacuuacgauuauccuaaguacagugaggaagcgaaacugaacagagaggagaucgacgggguaaaacuugaauccaccaggauuuaucaaauacuggcaaucuacagcacaguugccucuucauuggugcucgucgugagucugggagcuauuagcuuuuggaugugcuccaaugguucuuuacagugccggaucuguaucuga

SEQ ID NO: 126621 - RNA, 1701 nt, Artificial Sequence; identical to SEQ ID NO: 126237
  derived and/or modified sequence opt3 from hemagglutinin__InfluenzaA__ADF28005

SEQ ID NO: 126622 - RNA, 1701 nt, Artificial Sequence; identical to SEQ ID NO: 126237
  derived and/or modified sequence opt3 from hemagglutinin__InfluenzaA__ADF28015

SEQ ID NO: 126623 - RNA, 1701 nt, Artificial Sequence; identical to SEQ ID NO: 125849
  derived and/or modified sequence opt3 from hemagglutinin__InfluenzaA__ADF28025

SEQ ID NO: 126624 - RNA, 1701 nt, Artificial Sequence; identical to SEQ ID NO: 125849
  derived and/or modified sequence opt3 from hemagglutinin__InfluenzaA__ADF28045

SEQ ID NO: 126625 - RNA, 1701 nt, Artificial Sequence
  derived and/or modified sequence opt3 from hemagglutinin__InfluenzaA__ADF28055
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaauuaugauucaaacaagggugucaccgccgcuuguccucacgcaggggccaaaaguuuuuacaagaaucugaucuggcucgugaaaaagggaaacagcuauccaaaauuaucuaaguccuacauaaaugacaagggcaaagaaguacugguucuuuggggcauccaucaccccucaacgagcgcugaucaacagaguuuguaccagaacgccgacgcguauguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaucagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuauaaugccgaacuccuugugcuguuggagaacgaacgcacccuagacuaccacgauagcaauguaaagaaccuguaugagaaaguucgaucacagcucaagaacaaugcaaaggagaucggcaacggauguuuugaguucuaccauaaaugcgacaauacauguauggaaagugugaagaacggcacuuaugauuacccuaaauauuccgaagaggccaagcugaauagagaagagauugacggggucaaacuugagagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 126626 - RNA, 1701 nt, Artificial Sequence; identical to SEQ ID NO: 125849
  derived and/or modified sequence opt3 from hemagglutinin__InfluenzaA__ADF28065

SEQ ID NO: 126627 - RNA, 1701 nt, Artificial Sequence; identical to SEQ ID NO: 124867
  derived and/or modified sequence opt3 from hemagglutinin__InfluenzaA__ADF28075

SEQ ID NO: 126628 - RNA, 1701 nt, Artificial Sequence; identical to SEQ ID NO: 125786
  derived and/or modified sequence opt3 from hemagglutinin__InfluenzaA__ADF28085

SEQ ID NO: 126629 - RNA, 1701 nt, Artificial Sequence; identical to SEQ ID NO: 124865
  derived and/or modified sequence opt3 from hemagglutinin__InfluenzaA__ADF28107

SEQ ID NO: 126630 - RNA, 1701 nt, Artificial Sequence; identical to SEQ ID NO: 126237
  derived and/or modified sequence opt3 from hemagglutinin__InfluenzaA__ADF28117

SEQ ID NO: 126631 - RNA, 1701 nt, Artificial Sequence
  derived and/or modified sequence opt3 from hemagglutinin__InfluenzaA__ADF29918
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucucgcuccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagaaaucaggagggaaggaugaacuacuauuggacccugguggaacccggugauaaaauuacauucgaggccacuggcaaccuagucguuccucgguacgcuuuugccauggaacgcaaugcagggagcggaaucauaauuucggacaccccagugcaugauugcaacacaaccugucaaacgccgaagggcgcuaucaauacuucucuccccuuccagaacauucacccuaucacaaucgguaaaugcccaaaguauguaaaguccaccaaacugagacuugccacugggcugaggaaugugcccucaauucagagucggggauuguuuggcgcgauagccggcuucaucgaagggggauggacagguauggucgacggcugguacggguaucaucaccagaacgaacaaggaagcggcuacgcagcugaccucaaguccacccagaaugccauugaugagaucacgaacaaaguuaauucugugauagagaagaugaacacccaguuuacagcuguggguaaagaguucaaucaccuggaaaagcgcauugaaaacuuaaauaagaaagucgacgauggguuccuggacaucuggacuuacaacgccgagcuccuugugcuguuggaaaaugagcgaacccuagauuaucaugacagcaacguaaagaaccuguacgagaaaguuagaucacagcucaagaauaacgcaaaagaaaucggcaauggauguuuugaguucuaucacaagugcgauaacacauguauggaaagugugaagaauggcacuuacgacuauccuaaauacuccgaggaagccaagcugaacagggaggagauugauggggucaaacuugaaagcacccggaucuaucaaauucuggcuauauacucuacaguggcgucaaguuugguccucgugguuagccugggagcaaucuccuuuuggaugugcucuaaugguucguuacagugccguauuuguaucuga

SEQ ID NO: 126632 - RNA, 1701 nt, Artificial Sequence
  derived and/or modified sequence opt3 from hemagglutinin__InfluenzaA__ADF42689
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgcagugagccugggagccaucgguuuuuggaugugcuccaacggcucuuuacagugccggauuuguaucuga

SEQ ID NO: 126633 - RNA, 1701 nt, Artificial Sequence
  derived and/or modified sequence opt3 from hemagglutinin__InfluenzaA__ADF42699
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggacacuauguaaacucagaggaguggcuccccugcaucuugguaagugcaacauagccggcuggauccuggggaauccugagugugaaucuuugucaaccgcaaguagcugguccuacauuguugagacuucuucgucagacaacggaacaugcuauccaggcgauuuuaucgacuacgaggagcucagggagcagcugagcaguguguccucuuucgaacgguuugagauguucccgaaaaccagcuccuggcccaaucacgauucaaacaagggugucacggccgcuuguccucaugcaggggccaagaguuuuuauaaaaaucugauuuggcucgugaagaaaggaaacagcuacccaaaguuaucuaaauccuauaucaaugacaagggcaaggaaguacugguucuuuggggcauacaccaccccucaacuagcgcugaucaacagaguuuguaccagaacgccgacgcguacguguucgucgggaccucucgcuauuccaaaaaguuuaaaccugagaucgcaauucgaccaaaggugcgugaucaggagggaagaaugaauuacuauuggacacugguggaacccggugacaaaaucacuuucgaggccaccggcaaccuagucguuccuagguacgcuuuugccauggaacggaacgcagggagcggaauuaucauaucggauacaccagugcaugacugcaauaccacgugucaaacuccgaagggcgcuauuaacacaucucuccccuuccagaauauccacccuauuaccaucgguaaaugcccaaaguauguaaaguccacuaaacugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaguccacgcagaacgccaucgacgagauuaccaauaaagugaacucuguuaucgagaagaugaauacacaguuuacugcuguggguaaagaguucaaccaccuggaaaagcggauagaaaauuuaaacaagaaagucgaugacggguuccuggauauuuggaccuacaaugccgagcuccuugugcuguuggaaaacgagcgcacacuagacuaucaugauagcaauguaaagaaccuguacgagaaaguucgaucacagcucaagaacaaugcaaaagaaaucggcaacggauguuuugaguucuaucacaagugcgacaauacuuguauggaaagugugaagaacggcaccuacgauuauccuaaauacuccgaggaagccaagcugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 126634 - RNA, 1701 nt, Artificial Sequence; identical to SEQ ID NO: 125849
  derived and/or modified sequence opt3 from hemagglutinin__InfluenzaA__ADF42709

SEQ ID NO: 126635 - RNA, 1701 nt, Artificial Sequence; identical to SEQ ID NO: 125849
  derived and/or modified sequence opt3 from hemagglutinin__InfluenzaA__ADF42719

SEQ ID NO: 126636 - RNA, 1701 nt, Artificial Sequence; identical to SEQ ID NO: 125849
  derived and/or modified sequence opt3 from hemagglutinin__InfluenzaA__ADF42729

SEQ ID NO: 126637 - RNA, 1701 nt, Artificial Sequence; identical to SEQ ID NO: 125849
  derived and/or modified sequence opt3 from hemagglutinin__InfluenzaA__ADF42739

SEQ ID NO: 126638 - RNA, 1701 nt, Artificial Sequence
  derived and/or modified sequence opt3 from hemagglutinin__InfluenzaA__ADF58349
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugagagagaaggaaggaugaacuacuauuggacccugguggagcccggugacaagauuacauucgaagccacuggcaaucuagucguuccucgguacgcuuuugccauggagcgcaacgcagggagcggaaucauaauuucggauaccccagugcaugacugcaacacaaccugucagacgccgaaaggcgcuaucaauacuucucuccccuuccaaaacauucacccuaucacaaucgguaagugcccaaaguauguaaaauccaccaagcugagacuugccacugggcugaggaaugugcccucaauucagagucggggauuguuuggcgcgauagccggcuucaucgaagggggauggacagguauggucgacggcugguacggguaucaucaccagaacgagcagggaagcggcuacgcagcugaucucaaauccacccaaaaugccauugacgagaucacgaacaagguaaauucuguuauagaaaagaugaacacccaguuuacagcuguggguaaggaguucaaucaccuggaaaagcgcauugagaacuuaaauaaaaaggucgaugacggguuccuggauaucuggacuuacaacgccgaacuccuugugcuguuggagaaugagcgaacccuagacuaucaugauagcaacgugaaaaaucuguacgaaaagguuagaucacagcucaaaaacaacgcaaaggagaucggcaauggauguuuugaguucuaucacaagugcgacaacacauguauggagagugugaaaaauggcacuuacgauuauccuaaguacuccgaagaggccaaacugaacagggaggaaauugacggggucaaacuugagagcacccggaucuaucagauucuggcuauauacucuacaguggcgucaaguuugguccucgugguuagccugggagcaaucuccuuuuggaugugcucuaaugguucguuacaaugccguauuuguaucuga

SEQ ID NO: 126639 - RNA, 1701 nt, Artificial Sequence; identical to SEQ ID NO: 126282
  derived and/or modified sequence opt3 from hemagglutinin__InfluenzaA__ADF58351

SEQ ID NO: 126640 - RNA, 1701 nt, Artificial Sequence
  derived and/or modified sequence opt3 from hemagglutinin__InfluenzaA__ADF80454
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccggagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuauaauugaaaagaugaauacccaguuuacagcuguugguaaagaguucaaccaccuggaaaagcggaucgagaauuuaaacaagaaaguggaugacggguuccuggauaucuggacuuacaaugccgaacuccuuguccuguuggagaacgagcgcacccuagacuaucaugauagcaaugugaagaaccuguacgaaaaaguacgaucacagcucaagaacaaugcaaaagagauuggcaacggauguuuugaguucuaucacaagugcgacgauacauguauggagaguguuaagaauggcacuuacgacuauccuaaauacuccgaagaggccaagcugaacagagaggaaaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126641 - RNA, 1701 nt, Artificial Sequence
  derived and/or modified sequence opt3 from hemagglutinin__InfluenzaA__ADF80462
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagaucucuagcuggcccaaccacgauuccaauaagggugucacagccgcuuguccucaugcaggggccaaaucauuuuauaagaaccugauauggcucgugaaaaagggaaauaguuacccaaaauuaagcaagucuuauaucaacgacaagggcaaagaaguacugguucuuuggggcauucaccaccccuccaccucagcugaucaacagagcuuguaccagaaugccgacgcguacguguucgucgggacgagucgcuauucuaagaaauuuaagccugagaucgcaauucgaccaaaagugcgugaucaggagggaagaaugaacuacuauuggacucugguggaacccggugacaagaucaccuucgaggccacaggcaaccuagucguuccuagguacgcuuuugccauggaacggaaugcaggguccggaauaauuaucagcgauacuccagugcaugacugcaacaccacaugucaaaccccgaaaggcgcuauuaauacgucgcuccccuuccagaacauccacccuaucacuauugguaagugcccaaaguauguaaaaucuacaaagcugcgccuugccaccgggcugagaaaugugcccuccauacagucaaggggauuguuuggcgcgaucgccggcuucauugaagggggauggacugguauggucgacggcugguacggguaucaucaccagaacgaacaaggaaguggcuacgcagcugaucucaaaagcacacagaaugccaucgacgagauaaccaacaagguaaauuccguuauugagaaaaugaacacgcaguuuaccgcuguggguaaggaguucaaucaccuggaaaagcggaucgaaaacuuaaauaaaaaggucgaugacggguuccuggauaucuggacauacaacgccgagcuccuugugcuguuggaaaaugagcgcacucuagacuaucaugauucuaacgugaaaaaccuguacgagaagguucgaagccagcucaaaaauaacgcaaaggaaauuggcaauggauguuuugaguucuaucacaagugcgacaacaccuguauggaaucagugaaaaauggcacauacgauuauccuaaguacagugaggaagccaaacugaacagagaggagaucgacggggucaaacuugaauccacuaggauuuaucaaauacuggcuaucuacagcaccguggcgucuucauugguccucgugguuagucugggagcaauuagcuuuuggaugugcuccaaugguucuuuacagugccggaucuguaucuga

SEQ ID NO: 126642 - RNA, 1701 nt, Artificial Sequence; identical to SEQ ID NO: 124685
  derived and/or modified sequence opt3 from hemagglutinin__InfluenzaA__ADF80470

SEQ ID NO: 126643 - RNA, 1701 nt, Artificial Sequence
  derived and/or modified sequence opt3 from hemagglutinin__InfluenzaA__ADF80478
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuaauggucccaagguacgcuuuugccauggaacggaacgcaggguccggaaucauaauuagcgauaccccgguucaugacugcaauacaaccugucaaacgcccaaaggcgcuaucaacacuucgcucccuuuccagaauauucacccaaucacaaucgguaagugccccaaguaugugaaaucuaccaagcugcgccuugccacugggcugagaaacguaccuuccauucagucaaggggauuguuuggcgcgauagccggcuucaucgaagggggauggacagguaugguggacggcugguacggguaucaucaccagaaugaacaaggaaguggcuacgcagcugaucucaaaagcacccagaacgccauugacgagaucacgaauaaggucaacuccgugauagagaaaaugaauacccaguuuacagcuguugguaaggaguucaaccaccuggaaaagcggauugaaaauuuaaacaaaaagguggaugacggguuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaaucggcaacggauguuuugaguucuaucacaagugcgacaauacauguauggaaucaguuaaaaacggcacuuacgauuauccaaaguacagugaggaagccaaacugaauagagaggagauugacggggugaaacuugaauccaccaggaucuaucaaauucuggcuauauacagcacagucgcgucuucauuggugcucgucgugagucugggagcaaucagcuuuuggaugugcuccaacgguucuuuacagugccggauuuguaucuga

SEQ ID NO: 126644 - RNA, 1701 nt, Artificial Sequence
  derived and/or modified sequence opt3 from hemagglutinin__InfluenzaA__ADF80494
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuacucgucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggacggcugguacggguaucaucaccagaaugaacaaggaagcggcuacgcagcugaucugaaguccacccagaacgccauugacgagaucacgaauaaggucaacucugugauagagaaaaugaauacccaguuuacagcuguugguaaggaguucaaccacuuagaaaagcggauugaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaacaaacgcaaaggaaaucggcaauggauguuuugaguucuaucacaagugcgacaacacuuguauggaaaguguuaaaaauggcaccuacgauuauccuaaguacuccgaggaagccaaacuuaacagagaggagauugacggggugaagcuggaaagcacaaggaucuaucaaauuuuggcuauauacucuaccgucgcgucaagucucgugcuggucgugagcuuaggagcaaucuccuuuuggaugugcucuaaugguucgcugcagugccggauuuguaucuga

SEQ ID NO: 126645 - RNA, 1701 nt, Artificial Sequence; identical to SEQ ID NO: 126644
  derived and/or modified sequence opt3 from hemagglutinin__InfluenzaA__ADF80498

SEQ ID NO: 126646 - RNA, 1701 nt, Artificial Sequence; identical to SEQ ID NO: 125309
  derived and/or modified sequence opt3 from hemagglutinin__InfluenzaA__ADF80502

SEQ ID NO: 126647 - RNA, 1701 nt, Artificial Sequence
  derived and/or modified sequence opt3 from hemagglutinin__InfluenzaA__ADF80506
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcucuauagccggcuggauccuggggaacccugagugugaaucauugaguacagcaagcuccuggucuuacauuguugagaccucgucaagcgacaauggaacuugcuauccaggcgauuuuaucgacuacgaagaacuccgggagcagcugaguuccgugucuagcuucgaacgcuuugagauuuucccgaaaacauccucauggcccaaccacgauccuaauaagggugucaccgccgcuuguccacaugcaggggccaagaguuuuuauaaaaaccugaucuggcucgugaagaaagaaaauagcuaccccaaguuaucuaaauccuauauaaacgacaagggaaaggagguacugguucuuuggggcauccaccacccuucaacgagcgcugaucaacagaguuuguaccagaaugccgacgcguacguguucgucggcacuucucgauauuccaaaaaguuuaaaccagagauugcaauccgucccaaggugagagaucaggaagggaggaugaacuacuauuggacccugguggagccuggagacaaaauuacauucgaagccacugguaaucuagucguuccacgguacgcuuuugccauggagcgcaacgcaggcagcgggaucauaauuucggauaccccggugcaugacugcaacacaaccugucaaacgcccaagggagcuaucaauacuucucucccuuuccagaacauucacccaaucacaaucggcaaaugccccaaguauguaaaguccaccaaacugagacuugccacuggucugaggaaugugccuucaauucagagucggggguuguuuggagcgauagccggcuucaucgaaggcggguggacaggaauggucgacgguugguacggcuaucaucaccagaacgagcaagggagcggauacgcagcugaucucaaguccacccagaaugccauugacgagaucacgaacaaaguuaauucugugauagaaaagaugaacacccaguuuacagcugugggcaaagaguucaaucaccuggaaaagcgcauugagaacuuaaauaagaaagucgaugacgguuuccuggauaucuggacuuacaacgccgaacuccuugugcuguuggagaaugagcgaacccuagacuaucaugauagcaacguaaagaaucuguacgaaaaaguuagaucacagcucaagaacaacgcaaaagagaucgggaauggcuguuuugaguucuaucacaagugcgacaacacauguauggagagugugaagaauggaacuuacgauuauccaaaauacuccgaagaggccaagcugaacagggaggaaauugacggcgucaaacuugagagcacccggaucuaucaaauucuggcuauauacucuacaguggcgucaaguuugguccucgugguuagccugggggcaaucuccuuuuggaugugcucuaauggaucguuacagugccguauuuguaucuga

SEQ ID NO: 126648 - RNA, 1701 nt, Artificial Sequence
  derived and/or modified sequence opt3 from hemagglutinin__InfluenzaA__ADF83741
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucggugaugcgcucugacgcacccauugggaaauguaauuccgacugcaucacuccuaacggcucaauaccaaaugauaagcccuuucagaacgucaaucgaauuacauauggugccuguccuagauacgugaaacaaaacacccugaaacuugcuacugggaugaggaaugugccagagaagcagacacggggaaucuucggcgccaucgcaggcuuuauugaaaacgggugggagggaauggucgacgguugguauggcuuccgucaccagaauagugaagggcgcggacaagcugccgaucuuaagagcacccaggcggccaucgaccagauuaacggcaaauugaauagacucauagguaagacgaacgagaaguuccaccagaucgagaaagaauuuuccgagguugaagggaggauucaagaucuggagaaguacguggaagacaccaaaaucgauuuauggucuuauaacgcagagcugcucguagcucuugagaaucagcauacaaucgaccugacugauagcgaaaugaacaaguuguucgagaaaaccaagaagcagcuacgggaaaaugccgaggacaugggcaacggaugcuuuaaaauuuaccacaagugugauaaugcuugcauaggcucaauccgaaacgggacauaugaccaugacguguaccgcgaugaagcccugaauaacagauuccagauuaaaggagucgagcucaagagugguuacaaagacuggauccuguggauuuccuuugcaaucagcugcuuccuucuguguguggccuugcucggcuuuauaaugugggcuugccaaaaggggaauaucagguguaacauuugcaucuga

SEQ ID NO: 126649 - RNA, 1701 nt, Artificial Sequence; identical to SEQ ID NO: 125427
  derived and/or modified sequence opt3 from hemagglutinin__InfluenzaA__ADF83752

SEQ ID NO: 126650 - RNA, 1701 nt, Artificial Sequence; identical to SEQ ID NO: 126237
  derived and/or modified sequence opt3 from hemagglutinin__InfluenzaA__ADF83763

SEQ ID NO: 126651 - RNA, 1701 nt, Artificial Sequence; identical to SEQ ID NO: 126237
  derived and/or modified sequence opt3 from hemagglutinin__InfluenzaA__ADF83773

SEQ ID NO: 126652 - RNA, 1701 nt, Artificial Sequence
  derived and/or modified sequence opt3 from hemagglutinin__InfluenzaA__ADF83783
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuacaaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 126653 - RNA, 1701 nt, Artificial Sequence; identical to SEQ ID NO: 126312
  derived and/or modified sequence opt3 from hemagglutinin__InfluenzaA__ADF83793

SEQ ID NO: 126654 - RNA, 1701 nt, Artificial Sequence
  derived and/or modified sequence opt3 from hemagglutinin__InfluenzaA__ADF83803
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaggagcucagggagcagcugucaagcgugaguuccuucgaacgguuugagauuuucccgaagaccucuagcuggcccaaucacgauuccaacaagggugucacggccgcuuguccucaugcaggggccaaaucauuuuauaagaaucugaucuggcucgugaaaaagggaaacaguuacccaaaauuaagcaagucuuauauaaaugacaagggcaaagaaguacugguucuuuggggcauccaccaccccuccacuucagcugaucaacagagcuuguaccagaacgccgacgcguacguguucgucgggaccagucgcuauucuaagaaauuuaagccugagauugcaauccgaccaaaagugcgugaucaggagggaagaaugaauuacuauuggacacugguggaacccggugacaagauuacuuucgaggccaccggcaaccuagucguuccuagguacgcuuuugccauggaacggaacgcaggguccggaaucauaauuagcgauacaccagugcaugacugcaauaccacgugucaaacuccgaaaggcgcuaucaacacaucgcuccccuuccagaauguacacccuauuaccaucgguaagugcccaaaguaugugaaaucuacuaagcugcgccuugccacagggcugagaaacguccccuccauccagucaaggggauuguuuggcgcgauugccggcuucauagaagggggauggaccgguaugguggacggcugguacggguaucaucaccagaaugaacaaggaaguggcuacgcagcugaucucaaaagcacgcagaacgccaucgacgagauuaccaauaagguuaacuccgugaucgagaaaaugaauacacaguuuacugcugucgguaaggaguucaaccaccuggaaaagcggauagaaaauuuaaacaaaaagguggaugacggguuccuggauauuuggaccuacaaugccgagcuccuuguacuguuggaaaacgagcgcacacuagacuaucaugauucuaauguuaaaaaccuguacgagaaggugcgaagccagcucaaaaacaaugcaaaggaaacuggcaacggauguuuugaguucuaucacaagugcgacaauaccuguauggaaucagucaaaaacggcacauacgauuauccuaaguacagugaggaagccaaacugaauagagaggagaucgacggggugaaacuugaauccaccaggaucuaucaaauucuggcuaucuacagcacugucgcgucuucauuggugcucguugugagucugggagcaauuagcuuuuggaugugcuccaacgguucuuuacagugccggauauguaucuga

SEQ ID NO: 126655 - RNA, 1701 nt, Artificial Sequence
  derived and/or modified sequence opt3 from hemagglutinin__InfluenzaA__ADF83813
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 126656 - RNA, 1701 nt, Artificial Sequence
  derived and/or modified sequence opt3 from hemagglutinin__InfluenzaA__ADF83823
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacauucccaguauacagagcaggggauuguuuggcgccaucgcgggcuucauugaagggggauggacagguaugguggacggcugguacggguaucaucaccagaaugaacaaggauccggcuacgccgcagaucucaaaucuacccagaacgcuaucgacgagauaacgaauaaggucaacagcgugauugagaaaaugaauacccaguuuacagccguugguaaggaguucaaccaccuggaaaagcggaucgaaaauuuaaacaaaaagguggaugacggguuccuggauaucuggacuuacaaugcugagcuccuuguccuguuggaaaacgagcgcacccuagacuaucaugauucaaaugugaaaaaccuguacgagaagguacgaagucagcucaaaaacaaugccaaggaaauuggcaacggauguuuugaguucuaucacaagugcgacaauacauguauggaauccguuaaaaacggcacuuacgauuauccuaaguacagcgaggaagcaaaacugaauagagaggagaucgacggggugaaacuugaaucuaccaggauuuaucaaauacuggccaucuacucaacagucgcuaguagcuuggugcucgucgugucccugggagcgauuucuuuuuggaugugcucgaacgguagcuuacagugccggaucuguaucuga

SEQ ID NO: 126657 - RNA, 1701 nt, Artificial Sequence; identical to SEQ ID NO: 126237
  derived and/or modified sequence opt3 from hemagglutinin__InfluenzaA__ADF83833

SEQ ID NO: 126658 - RNA, 1701 nt, Artificial Sequence; identical to SEQ ID NO: 126237
  derived and/or modified sequence opt3 from hemagglutinin__InfluenzaA__ADF83843

SEQ ID NO: 126659 - RNA, 1701 nt, Artificial Sequence; identical to SEQ ID NO: 126237
  derived and/or modified sequence opt3 from hemagglutinin__InfluenzaA__ADF83853

SEQ ID NO: 126660 - RNA, 1701 nt, Artificial Sequence
  derived and/or modified sequence opt3 from hemagglutinin__InfluenzaA__ADF83873
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucaacugaucaacagagcuuguaccagaaugcugacgccuacguguucgucgggaccagucgcuauucuaagaaauuuaagccugagauugcgauccgaccaaaagugcgugaucaggagggaagaaugaacuacuauuggacacugguggaacccggugacaagauuacuuucgaggcaaccggcaaccuagucguuccuagguacgccuuugcuauggaacggaaugccggguccggaaucauaauuagcgauacaccagugcaugacugcaacaccacgugucaaacuccgaaaggcgcaaucaauacaucgcuccccuuccagaacauucacccuaucaccaucgguaagugcccaaaguauguaaaaucuacuaagcugcgccuugcuacagggcugagaaaugugcccuccauucagucaaggggauuguuuggcgccauagcgggcuucaucgaagggggauggaccgguauggucgacggcugguacggguaucaucaccagaacgaacaaggaaguggcuacgccgcagaucucaaaagcacgcagaaugcuauugacaagaucaccaacaaaguuaauuccgugauagagaagaugaacacacaguuuacugccguggguaaggaguucaaucaccuggaaaaacggauugagaacuuaaauaagaaagucgaugacggguuccuggauaucuggaccuacaacgcugaacuccuugugcuguuggagaaugaacgcacacuagacuaucaugauucuaacguaaagaaccuguacgagaaaguucgaagccagcucaagaauaacgccaaggagaucggcaauggauguuuugaguucuaucacaaaugcgacaacacuuguauggaaucagugaagaauggcaccuacgauuauccuaaauacagugaagaggcaaagcugaacagagaagagauugacggggucaaacuugaguccacaaggaucuaucaaauucuggccauauacagcaccguggcuucuucauugguccucgugguuagucugggagcgaucagcuuuuggaugugcuccaaugguucuuuacagugccggauuuguaucuga

SEQ ID NO: 126661 - RNA, 1701 nt, Artificial Sequence; identical to SEQ ID NO: 125849
  derived and/or modified sequence opt3 from hemagglutinin__InfluenzaA__ADF83885

SEQ ID NO: 126662 - RNA, 1701 nt, Artificial Sequence
  derived and/or modified sequence opt3 from hemagglutinin__InfluenzaA__ADF83895
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagggcaaagaaguacuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacaagaucacgaauaaaguuaacucugugauagagaagaugaauacccaguuuacagccgucgguaaggaguucaaccaccuggaaaaacggauugagaauuuaaacaagaaaguggaugacggguuccuggauaucuggacuuacaaugcugaacuccuuguacuguuggagaacgaacgcacccuagacuaucaugauagcaauguuaagaaccuguacgagaaaauccgaucacagcucaagaacaaugccaaggagauuggcaacggauguuuugaguucuaucacaaaugcgacaauacauguauggaaagugugaagaacggcacuuacgauuauccuaaauacuccgaagaggcaaagcugaauagagaagagaucgacggggucaaacuugagagcaccaggauuuaucaaauacuggccaucuacucuacaguggcuucaaguuugguccucgugguuagccugggagcgauuuccuuuuggaugugcucuaacgguucguuacagugccggaucuguaucuga

SEQ ID NO: 126663 - RNA, 1701 nt, Artificial Sequence; identical to SEQ ID NO: 126237
  derived and/or modified sequence opt3 from hemagglutinin__InfluenzaA__ADF83915

SEQ ID NO: 126664 - RNA, 1701 nt, Artificial Sequence
  derived and/or modified sequence opt3 from hemagglutinin__InfluenzaA__ADF84441
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccucacacgacaguaacaagggugucaccgccgcuuguccucaugcaggggccaagagcuuuuauaaaaaucugaucuggcucgugaaaaagggaaacucuuacccaaaauuauccaagucauauauaaaugauaagggcaaagaaguacugguucuuuggggcauccaccaccccagcacgagugcugaccaacagucuuuguaccagaacgccgaugcguacguguucgucgggacuucccgcuauagcaagaaauuuaagccugagauugcaauccgaccaaaagugcgugaccaggagggaagaaugaauuacuauuggacccugguggaacccggugauaagauuacauucgaggccacuggcaaccuagucguuccuagguacgcuuuugccauggaacggaacgcagggucgggaaucauaauuucugacaccccagugcaugauugcaauacaaccugucaaacgccgaaaggcgcuaucaacacuucccuccccuuccagaauauucacccuaucacaaucgguaagugcccaaaguauguaaaaucaaccaagcugcgccuugccacugggcugagaaacgugcccaguauucagagcaggggauuguuuggcgcgauagccggcuucaucgaagggggauggacagguauggucgacggcugguacggguaucaucaccagaaugaacaaggauccggcuacgcagcugaccucaaaucuacccagaacgccauugauaagaucacgaauaaagugaacagcguuauagagaagaugaauauucaguuuaccgcuguggguaaggaguucaaccaccuggaaaaacggaucgagaauuuaaacaagaaagucgacgauggguuccuggacaucuggacauacaaugccgaacuccuugugcuguuggagaacgaacgcacucuagauuaucaugacucaaauguaaagaaccuguacgagaaaguucgaagucagcucaagaacaaugcaaaggagauuggcaacggauguuuugaguucuaucacaaaugcgauaauaccuguauggaauccgugaagaacggcacauacgacuauccuaaauacagcgaagaggccaagcugaauagagaagagaucgauggggucaaacuugagucuacuaggauuuaucaaauacuggcuaucuacucaaccguggcgaguagcuugguccucgugguuucccugggagcaauuucuuuuuggaugugcucgaacgguagcuuacagugccggaucuguaucuga

SEQ ID NO: 126665 - RNA, 1701 nt, Artificial Sequence; identical to SEQ ID NO: 125849
  derived and/or modified sequence opt3 from hemagglutinin__InfluenzaA__ADF84459

SEQ ID NO: 126666 - RNA, 1701 nt, Artificial Sequence; identical to SEQ ID NO: 126237
  derived and/or modified sequence opt3 from hemagglutinin__InfluenzaA__ADF84469

SEQ ID NO: 126667 - RNA, 1701 nt, Artificial Sequence; identical to SEQ ID NO: 126298
  derived and/or modified sequence opt3 from hemagglutinin__InfluenzaA__ADF84479

SEQ ID NO: 126668 - RNA, 1701 nt, Artificial Sequence; identical to SEQ ID NO: 126237
  derived and/or modified sequence opt3 from hemagglutinin__InfluenzaA__ADF84489

SEQ ID NO: 126669 - RNA, 1701 nt, Artificial Sequence; identical to SEQ ID NO: 126237
  derived and/or modified sequence opt3 from hemagglutinin__InfluenzaA__ADF85017

SEQ ID NO: 126670 - RNA, 1701 nt, Artificial Sequence; identical to SEQ ID NO: 126237
  derived and/or modified sequence opt3 from hemagglutinin__InfluenzaA__ADF87152

SEQ ID NO: 126671 - RNA, 1701 nt, Artificial Sequence
  derived and/or modified sequence opt3 from hemagglutinin__InfluenzaA__ADF87162
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuuccaaguauagcaaaaaguuuaaaccugagauugcgauccgcccaaaggugcgagaucaggagggacguaugaauuacuauuggacccugguggaacccggugacaaaauuacauucgaggcaacuggcaaccuagucguuccuagauacgccuuugcuauggaaaggaacgccgggucgggaaucauaauuucugauaccccagugcaugacugcaauacaaccugucaaacgccggagggcgcaaucaacacuucccuccccuuccagaauauucacccuaucacaaucgguaagugcccaaaguauguaaaaucaaccaagcugcggcuugcuacugggcugcgcaacgugcccaguauucagagcagaggauuguuuggcgccauagcgggcuucaucgaagggggauggacagguauggucgacggcugguacggguaucaucaccagaaugagcaaggauccggcuacgccgcagaucucaaaucuacccagaacgcuauugacgagaucacgaauaaggugaacagcguuauagaaaagaugaauacccaguuuacagccguggguaaggaguucaaccaccuggaaaagaggauugagaauuuaaacaaaaaggucgaugacggguuccuggauaucuggacuuacaaugcugaacuccuugugcuguuggagaacgagcggacccuagacuaucaugauucaaauguuaaaaaccuguacgaaaagguacgcagucagcucaaaaacaaugccaaggagaucggcaacggauguuuugaguucuaucacaagugcgacaauacauguauggaguccgugaaaaacggcacuuacgauuauccuaaguacagcgaagaggcaaaacugaaucgagaggaaauugacggggucaaacuugagucuaccagaaucuaucaaauucuggccauauacucaacaguggcuaguagcuugguccucgugguuucccugggagcgaucucuuuuuggaugugcucgaacgguagcuuacagugcaggauuuguaucuga

SEQ ID NO: 126672 - RNA, 1701 nt, Artificial Sequence; identical to SEQ ID NO: 126237
  derived and/or modified sequence opt3 from hemagglutinin__InfluenzaA__ADF87172

SEQ ID NO: 126673 - RNA, 1701 nt, Artificial Sequence
  derived and/or modified sequence opt3 from hemagglutinin__InfluenzaA__ADF87182
augaacgccauccuggugguccuccuuuacaccuucgcuacagcaaaugccgacacucugugcauuggcuaucacgcgaacaauagcacggauaccguugacacauuguuagagaagaacgugacuguaacccauuccgugaaucugcuagaagauaaacacaacgggaagcucuguaaacugagaggagucgcuccccuucaucuggguaagugcaauauagccggcuggaucuuggggaacccugagugugaaucucucucaacagcaaguagcugguccuacauuguggagaccucuucgucagacaauggaacuugcuauccaggcgauuuuaucgacuacgaggagcugagggagcagcugagcaguguuuccucuuucgaacgguuugagauuuucccgaaaacaagcuccuggcccaaccacgauucaaauaagggugugaccgccgcuuguccucaugcaggggccaagaguuuuuauaaaaaccucaucugguuagucaagaaaggaaauagcuacccaaagcugucuaaauccuauauaaacgacaagggcaaggaagugcuuguauuguggggcauccaccaccccucaacgagcgcugaucaacagagucuguaccagaaugccgacgcguacguuuucguggggacuucucgcuauuccaaaaaguuuaaaccugagauugcaauccgaccaaagguccgugaucaggagggaagaaugaacuaccauuggacccuaguggaacccggugacaaaauuacauucgaggccacuggcaaccucguggucccuagguaugcuuuugccauggaacggaaugcagggagcggaaucauaauuucggaugcuccaguucacgacugcaacaccacaugucaaaccccgaagggcgccaucaauacgucucugcccuuccagaacauucauccuaucacuaucgguaaaugcccaaaguacgugaaguccacaaaacuucgccuggcgaccggguugagaaauguacccucaauucagaguaggggacucuuuggcgccauagcaggcuucaucgaagggggauggacugguaugguggacggcugguauggguaccaccaccagaacgaacaaggaagcggcuaugcugccgaucugaaguccacacagaaugcuauugacgagaucaccaacaaaauaaauucugucauugagaagaugaacacgcaguuuaccgccguggguaaagaguucaaucauuuagaaaagcggaucgaaaaccugaauaagaaaguugaugacggguuccucgauaucuggacauacaacgcagagcuucugguguugcuagaaaaugagcgcacucuggacuaccacgauagcaacgucaagaaccucuaugagaaagugcgaucacagcugaagaauaacgccaaagaaauuggcaauggauguuuugaguucuaccauaagugcgacaacaccuguauggaaaguguaaagaauggcacauaugauuacccuaaauauuccgaggaagcuaaacuuaacagagaggagaucgacgggguuaagcuggaaagcacuaggauuuaccaaauauuggcgaucuauucuaccguggcaucaagucucguccugguggucagcuuaggagccauuuccuuuuggaugugcucuaaugguucgcugcagugccggaucuguaucuga

SEQ ID NO: 126674 - RNA, 1701 nt, Artificial Sequence; identical to SEQ ID NO: 126237
  derived and/or modified sequence opt3 from hemagglutinin__InfluenzaA__ADF87192

SEQ ID NO: 126675 - RNA, 1701 nt, Artificial Sequence
  derived and/or modified sequence opt3 from hemagglutinin__InfluenzaA__ADF87202
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuuugcagcugaucucaaauccacccagaacgccauugacaagaucacgaauaaagugaacucuguuauagagaagaugaauacccaguucacagcuguggguaaggaguucaaccaccuggaaaaacggauugagaauuuaaacaagaaagucgaugacggguuucuggauaucuggacuuacaaugccgaacuccuugugcuguuggagaacgaacgcacccuagacuaccaugauagcaauguaaagaaccuguaugagaaaguucgaucacagcucaagaacaaugcaaaggagaucggcaacggauguuucgaauuuuaccacaaaugcgacaauacauguauggagagugugaagaacggcacuuaugauuacccuaaauauuccgaagaggccaagcugaauagagaagagauugacggggucaaacuugagagcaccaggaucuaccaaauucuggcuauauauucuacaguggcgucaaguuugguccucgugguuagccugggagcaaucuccuucuggaugugcucuaacgguucguuacagugccggauuuguaucuga

SEQ ID NO: 126676 - RNA, 1701 nt, Artificial Sequence; identical to SEQ ID NO: 126237
  derived and/or modified sequence opt3 from hemagglutinin__InfluenzaA__ADF87212

SEQ ID NO: 126677 - RNA, 1701 nt, Artificial Sequence; identical to SEQ ID NO: 126400
  derived and/or modified sequence opt3 from hemagglutinin__InfluenzaA__ADF87232

SEQ ID NO: 126678 - RNA, 1701 nt, Artificial Sequence; identical to SEQ ID NO: 126237
  derived and/or modified sequence opt3 from hemagglutinin__InfluenzaA__ADF87242

SEQ ID NO: 126679 - RNA, 1701 nt, Artificial Sequence
  derived and/or modified sequence opt3 from hemagglutinin__InfluenzaA__ADF87252
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaaaagcuacccaaaguuaucuaaguccuauauaaaugauaaaggcaaggaaguacugguucuuuggggcauccaccaccccucaacgagcgcugaccaacagaguuuguaccagaacgccgaugcguacguguucgucgggacuucucgcuauuccaaaaaguuuaaaccugagauugcaauccgaccaaaggugcgugaccaggagggaagaaugaauuacuauuggacccugguggaacccggugauaaaauuacauucgaggccacuggcaaccuagucguuccuagguacgcuuuugccauggaacggaacgcagggagcggaaucauaauuucggacaccccagugcaugauugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaccucaaguccacccagaacgccauugauaaaaucacgaauaaggugaacucuguuauagagaagaugaauacccaguuuacagcuguggguaaagaguucaaccaccuggaaaagcggauugagaauuuaaacaaaaaggucgacgauggguuccuggacaucuggacuuacaaugccgaacuccuugugcuguuggagaacgaacgcacccuagauuaucaugacagcaauguaaagaaccuguacgagaagguucgaucacagcucaagaacaaugcaaaagagaucggcaacggauguuuugaguucuaucacaagugcgauaauacauguauggaaagugugaaaaacggcacuuacgacuauccuaaguacuccgaagaggccaaacugaauagagaagagauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126680 - RNA, 1701 nt, Artificial Sequence; identical to SEQ ID NO: 126237
  derived and/or modified sequence opt3 from hemagglutinin__InfluenzaA__ADF87262

SEQ ID NO: 126681 - RNA, 1701 nt, Artificial Sequence; identical to SEQ ID NO: 125849
  derived and/or modified sequence opt3 from hemagglutinin__InfluenzaA__ADF87272

SEQ ID NO: 126682 - RNA, 1701 nt, Artificial Sequence; identical to SEQ ID NO: 125849
  derived and/or modified sequence opt3 from hemagglutinin__InfluenzaA__ADF87282

SEQ ID NO: 126683 - RNA, 1701 nt, Artificial Sequence
  derived and/or modified sequence opt3 from hemagglutinin__InfluenzaA__ADF87292
augaaggccauccuggugguccuccuuuacaccuucgcuacagcaaacgccgacacucugugcauuggcuaucacgcgaauaacagcacggauaccguugacacaguguugaaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaggaaguuggagcuacauuguugaaaccuccucuucggacaacggcacuugcuauccaggugauuuuaucgacuacgaggaacucagggagcagcugucaagcgugaguuccuucgagcgguuugaaauuuucccgaagacaucuagcuggcccaaucacgauuccaacaaaggggucaccgccgcuuguccucaugcaggagccaagucauuuuauaaaaaucugaucuggcucgugaagaaaggcaacaguuacccaaaguuaagcaagucuuauauaaaugacaaaggcaaggagguacugguucuuugggggauccaccaccccuccacgucagcugaucaacagagcuuguaccagaacgccgacgcguacguguucgucggaaccagucgcuauucuaaaaaguuuaaaccugaaauugcaauccgaccaaaggugcgugaucaggaggguagaaugaauuacuauuggacucugguggagcccggcgacaaaauuacauucgaagccacugggaaccuagucguuccuagguacgcuuuugccauggagcggaacgcaggauccggcaucauaauuagcgauaccccagugcaugacugcaauacaaccugucaaacgccgaagggugcuaucaacacuucgcuccccuuccagaauauucacccuaucacaaucgggaagugcccaaaauauguaaagucuaccaaacugcgccuugccacuggacugagaaacgugcccuccauucagucaaggggcuuguuuggcgcgauagccggguucaucgaaggagguuggacaggcauggucgacgggugguacggauaucaucaccagaaugagcaaggcagugguuacgcagcugaucucaagagcacccagaacgccauugacgaaaucacgaauaaagugaacuccguuauagagaagaugaauacccaguuuacagcuguggggaaggaguucaaccaccuggaaaaacggauugagaauuuaaacaagaaagucgaugacggcuuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggaaacggcuguuuugaguucuaucacaaaugcgacaauauguguauggaaucagugaagaacgggacauacgauuauccuaaauacagugaagaggccaagcugaauagagaagagauugacggagucaaacuugaguccacuaggaucuaucaaauucuggcuauauacagcaccguggcgucuucauugguccucgugguuagucugggugcaaucagcuuuuggaugugcuccaacggcucuuuacagugccggauuuguaucuga

SEQ ID NO: 126684 - RNA, 1701 nt, Artificial Sequence; identical to SEQ ID NO: 125849
  derived and/or modified sequence opt3 from hemagglutinin__InfluenzaA__ADF87302

SEQ ID NO: 126685 - RNA, 1701 nt, Artificial Sequence
  derived and/or modified sequence opt3 from hemagglutinin__InfluenzaA__ADF87331
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucaacuacgaggagcucagggagcagcugucaagcgugaguuccuucgaacgguuugagauuuucccgaagacaucuagcuggcccaaucacgacuccaacaaggguaucaccgccgcuuguccucaugcaggggccaaaucauuuuauaagaaucugauauggcucgucaaaaagggaaacaguuacccaaaauuaagcaagucuuauaucaaugauaagggcaaagaagugcugguacuuuggggcauucaccaccccuccacgucagcugaccaacagagcuuguaccagaacgccgaugcguacguuuucguggggaguucucgcuauuccaagaaauuuaagccugagaucgcaauucgaccaaaaguccgugaccaggagggaagaaugaacuacuauuggacucugguggaacccggugauaagaucaccuucgaggccacaggcaaucuaguggucccuagguacgcuuuugccauggaacggaacgcagggagcggaauaauuaucucggacacuccaguucaugauugcaauaccacaugucaaaccccgaaaggcgcuauuaacacgucucuccccuuccagaauauccacccuaucacuauugguaagugcccaaaguaugugaaauccacaaagcugcgccuugccaccgggcugagaaacguacccucaauacagaguaggggauuguuuggcgcgaucgccggcuucauugaagggggauggacugguaugguggacggcugguacggguaucaucaccagaaugaacaaggaagcggcuacgcagcugaccucaaauccacacagaacgccaucgauaagauaaccaauaaagucaacucugugauugagaagaugaauacgcaguuuaccgcuguugguaaggaguucaaccaccuggaaaaacggaucgagaauuuaaacaagaaaguggacgauggguuccuggacaucuggacauacaaugccgaacuccuuguccuguuggagaacgaacgcacucuagauuaucaugacagcaacgugaagaaucuguacgagaaaguacgaucacagcucaagaacaaugcaaaggagauuggcaacggauguuuugaguucuaucacaaaugcgauaauaccuguauggaaaguguuaagaacggcacauacgacuauccuaaauacuccgaagaggccaagcugaauagagaagagaucgauggggugaaacuugagagcacuaggauuuaucaaauacuggcuaucuacucuaccgucgcgucaaguuuggugcucgucgugagccugggagcaauuuccuuuuggaugugcucuaacgguucguuacagugccggaucuguaucuga

SEQ ID NO: 126686 - RNA, 1701 nt, Artificial Sequence; identical to SEQ ID NO: 124685
  derived and/or modified sequence opt3 from hemagglutinin__InfluenzaA__ADF87341

SEQ ID NO: 126687 - RNA, 1701 nt, Artificial Sequence
  derived and/or modified sequence opt3 from hemagglutinin__InfluenzaA__ADF87351
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugacucuuugucaacagcaaguagcugguccuacauuguugaaaccucuucgucagauaacggaacuugcuauccaggcgacuuuaucgauuacgaggaacucagggagcagcugagcaguguguccucuuucgagcgguuugaaauguucccgaagacaagcuccuggcccaaucacgacucaaacaagggugucaccgccgcuuguccucaugcaggggccaaaaguuuuuauaagaaucugauuuggcucgugaaaaagggaaacagcuacccaaaauuaucuaaguccuauaucaaugauaagggcaaagagguacugguucuuuggggcauacaccaccccucaacgagcgcugaccaacagaguuuguaccagaacgccgaugcguacguguucgucgggacuucucgcuauuccaagaaauuuaagccugaaaucgcaauucgaccaaaagugcgugaccaggagggaagaaugaauuacuauuggacccugguggagcccggugauaagaucacauucgaagccacuggcaaccuagucguuccuagguacgcuuuugccauggagcggaacgcagggagcggaauuaucauaucggacaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgauggcugguacggguaucaucaccagaaugagcaaggaagcggcuacgcagcugaccucaaauccacccagaacgccaucgaugaaauuacgaauaaggugaacucuguuaucgagaaaaugaauacccaguuuacagcuguggguaaggaguucaaccaccuggaaaagcggauagagaauuuaaacaaaaaggucgacgauggguuccuggacauuuggacuuacaaugccgaacuccuugugcuguuggagaacgaacgcacccuagauuaucaugacagcaauguaaagaaccuguacgagaagguucgaucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaauagagaagagaucgauggggucaaacuugagagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 126688 - RNA, 1701 nt, Artificial Sequence; identical to SEQ ID NO: 126312
  derived and/or modified sequence opt3 from hemagglutinin__InfluenzaA__ADF87361

SEQ ID NO: 126689 - RNA, 1701 nt, Artificial Sequence; identical to SEQ ID NO: 125849
  derived and/or modified sequence opt3 from hemagglutinin__InfluenzaA__ADF87371

SEQ ID NO: 126690 - RNA, 1701 nt, Artificial Sequence
  derived and/or modified sequence opt3 from hemagglutinin__InfluenzaA__ADG08115
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcguggucaggagggcagaaugaauuacuauuggacccugguggaacccggggacaagauuacauucgaggccacuggaaaccuagucguuccuagguacgcuuuugccauggaacggaacgcaggcagcgguaucauaauuucggauaccccagugcaugacugcaauacaaccugucaaacgccgaaaggggcuaucaacacuucucuccccuuccagaauauucacccuaucacaaucggaaagugcccaaaguauguaaaauccaccaagcugcgccuugccacuggccugagaaacgugcccucaauucagaguaggggcuuguuuggggcgauagccggauucaucgaggguggcuggacagggauggucgauggaugguacggcuaucaucaccagaaugaacaagguagcggguacgcagcugaccucaaauccacccagaacgccauugacgagaucacgaauaaggugaacucuguuauagagaaaaugaauacccaguuuacagcugugggcaaggaguucaaccaccuggagaagcggauugaaaauuuaaacaaaaaggucgaugacggauuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggguguuuugaguucuaucacaagugcgacaauacauguauggaaagugugaaaaacggaacuuacgauuauccuaaguacuccgaggaagccaaacugaauagagaggagauugacggugucaaacuugaaagcaccaggaucuaucaaauucuggcuauauacucuacaguggcgucaaguuugguccucgugguuagccugggcgcaaucuccuuuuggaugugcucuaacgggucguuacagugccggauuuguaucuga

SEQ ID NO: 126691 - RNA, 1701 nt, Artificial Sequence; identical to SEQ ID NO: 125427
  derived and/or modified sequence opt3 from hemagglutinin__InfluenzaA__ADG21004

SEQ ID NO: 126692 - RNA, 1701 nt, Artificial Sequence; identical to SEQ ID NO: 125427
  derived and/or modified sequence opt3 from hemagglutinin__InfluenzaA__ADG21006

SEQ ID NO: 126693 - RNA, 1701 nt, Artificial Sequence
  derived and/or modified sequence opt3 from hemagglutinin__InfluenzaA__ADG21008
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaaucuuauucgaauuguuaccccuaugacgucccugauuacgccucacugaggagcuugguggcaaguuccggcacucucgaauuuaacaaugagucuuucaacuggacagguguuacccagaaugggacgagcuccgccugcauucggaagucaaacaauagcuuuuucagccgccugaacuggcugacucaucucaaguuuaaauauccagcuuuaaaugugaccaugcccaacaacgagcaguucgacaagcuguacaucuggggaguccaccauccuggcacagauaaugaccagauuuuucuuuaugcacaagccucuggccgaaucacuguguccaccaaacguucacagcagacaguaauaccaaacauugggagcagacccaggguucggaauaucccuagucgcauuucuaucuacuggaccaucgugaagccaggagauauuuugcugauaaacuccacggguaaucuaaucgcuccgagaggcuacuucaaaauuaggagcgggaagucgucuaucaugcgguccgacgcccccauaggaaaguguaacucagaaugcauuacuccuaauggcaguaucccaaacgacaaacccuuucagaaugucaaccgcaucacauauggugcguguccucgauacgugaagcaaaauacccucaaacuggcaacugggaugagaaacgugccagagaagcagacaaggggaauuuucggcgccaucgcuggcuuuauugaaaaugggugggagggaauggucgaugguugguauggcuuccggcaccagaacagcgaggggcguggacaagccgcagaccuuaaauccacccaggcugccauagaucagaucaauggcaagcugaaccgcuugauugguaaaacgaacgaaaaguuccaccagaucgagaaggaauuuucugagguugaagggagaauccaagaccucgagaaauacguggaggauaccaagauugaccuguggagcuauaaugcggaauuacugguagcccucgagaaccagcauacaauagaucuuacugacucagaaaugaauaaacuguucgagaagaccaaaaagcaguugagggaaaacgcagaggauaugggcaauggaugcuuuaagaucuaccacaaaugugacaacgcuugcauuggcaguauccggaaugggacauaugaucaugacguguaccgagacgaggcccuaaacaaucgcuuccagauuaagggagucgaacugaaauccgguuacaaggauuggauccucuggauaaguuuugcuaucucuugcuuccugcuuuguguggcccuguugggcuuuauuaugugggcaugccaaaaagggaacaucagauguaauauuugcaucuga

SEQ ID NO: 126694 - RNA, 1701 nt, Artificial Sequence
  derived and/or modified sequence opt3 from hemagglutinin__InfluenzaA__ADG21009
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuacguuuuaaguauccagcacugaacgugaccaugcccaacaaugagcaguucgauaaacuuuacauuuggggaguccaccauccuggcacagacaacgaucagaucuuuuuguaugcccaagcuagcggcagaauuacugugucuaccaagaggucccagcagacaguaaucccaaauauagggucacggccccgcguuagaaacauuccuagcaggaucaguauuuacuggaccaucgugaagccaggagacauccugcuaauuaauucuacggguaaccucauagccccgcggggcuacuucaaaauccgcuccggaaagagcucgauuaugcgaucugaugcgcccaucgggaaauguaauuccgaaugcauaacuccuaacggcucaauuccaaaugacaagcccuuucagaacgucaauagaaucacauauggugcauguccuagguacgugaagcaaaacacccugaaacuugccacugggaugcggaaugugccagagaagcagacacguggaaucuucggcgcuauugccggcuuuaucgaaaacgggugggagggaauggucgacgguugguauggcuuccgccaccagaauagugaggggagaggacaagcagcugaucugaaaagcacccaggccgcgauugaccagauaaacggcaaguugaacaggcucaucgguaaaacgaaugaaaaguuccaccagauugagaaagaauuuuccgagguugaagggcggauccaagaucuggagaaguacguggaggacaccaagaucgauuuauggucuuauaacgccgaacugcucguagcacuugagaaucagcauacaauugaccugacugauagcgaaaugaacaaauuguucgagaagaccaaaaagcagcuacgagaaaaugcugaggacaugggcaacggaugcuuuaaaauauaccacaagugugauaaugccugcaucggcucaauucgcaacgggacauaugaccaugauguguacagagacgaggcucugaauaacagguuccagaucaagggagucgaacucaaaagugguuacaaggacuggauucuguggaucuccuuugccauaagcugcuuccuucuguguguggcauugcucggcuuuaucaugugggccugccaaaaagggaauauucgguguaacaucugcauuuga

SEQ ID NO: 126695 - RNA, 1701 nt, Artificial Sequence; identical to SEQ ID NO: 125427
  derived and/or modified sequence opt3 from hemagglutinin__InfluenzaA__ADG21010

SEQ ID NO: 126696 - RNA, 1701 nt, Artificial Sequence
  derived and/or modified sequence opt3 from hemagglutinin__InfluenzaA__ADG21011
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaagcuguacauuuggggaguccaccauccuggcacagauaaagaccagaucuuuuuguaugcccaagcuagcggccguauuacugugucuaccaagagaucccagcaggccguaaucccaaacauagggucaaggccccggguucgcgauauuccuagcagaaucaguauuuacuggacaaucgugaaaccaggagacauccugcuaauuaauucuaccgguaaccucauagcgccgaggggcuacuucaagauccgguccgggaaaagcucgauuaugcgcucugacgcacccaucggaaaguguaauuccgaaugcauaacgccuaacggcucaauuccaaaugauaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgacgguugguauggcuuccgucaccagaauagugaggggcgcggacaagcugccgaucuuaagagcacacaggcggccauugaccagauaaacggcaaauugaauagacucaucgguaagaccaacgaaaaauuccaccagauugagaaggaauuuuccgagguugaagggaggauccaagaucuggagaaguacguggaggacacgaaaaucgauuuauggucuuauaacgcagaacugcucguagcucuugagaaucagcauaccauugaccugacagauagcgaaaugaacaaguuguucgagaaaacuaagaaacagcuacgggaaaaugccgaggacaugggcaacggaugcuuuaagauauaccacaagugugauaaugcuugcaucggcucaauucgaaacgggaccuaugaccaugacguguaccgcgaugaggcccugaauaacagauuccagaucaaaggagucgaacucaagagugguuacaaagacuggauucuguggaucuccuuugcaauaagcugcuuccuucuguguguggccuugcucggcuuuaucaugugggcuugccaaaaggggaauauuagguguaacaucugcauuuga

SEQ ID NO: 126697 - RNA, 1701 nt, Artificial Sequence; identical to SEQ ID NO: 125427
  derived and/or modified sequence opt3 from hemagglutinin__InfluenzaA__ADG21012

SEQ ID NO: 126698 - RNA, 1701 nt, Artificial Sequence; identical to SEQ ID NO: 125427
  derived and/or modified sequence opt3 from hemagglutinin__InfluenzaA__ADG21013

SEQ ID NO: 126699 - RNA, 1701 nt, Artificial Sequence
  derived and/or modified sequence opt3 from hemagglutinin__InfluenzaA__ADG21014
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauucggcgcuccaacaauucauuuuucagucgacugaacuggcugacucaucucaauuuuaaguauccagcauuaaacgugaccaugcccaacaaugagcaguucgacaagcuguacaucuggggaguccaccauccuggcacagauaaagaccagauuuuucuuuaugcccaagcuagcggccguaucacugugucuaccaagagaucccagcaggccguaauaccaaacauugggucaaggccccggguucgcaauaucccuagcagaauuaguaucuacuggacaaucgugaaaccaggagauauuuugcugauaaacucuaccgguaaucuaaucgcgccgaggggcuacuucaagauucgguccgggaaaagcucgaucaugcgcucugacgcacccauaggaaaguguaacuccgaaugcauuacgccuaauggcucaaucccaaacgacaagcccuuucagaaugucaaccgaaucacuuauggugccuguccuagauacgugaaacaaaauacacucaagcuggcuaccgggaugaggaacgugccagagaaacagacucggggaauuuucggcgccaucgcaggcuuuauugaaaaugggugggagggaauggucgaugguugguauggcuuccgucaccagaacagugaggggcgcggacaagcugccgaccuuaagagcacacaggcggccauagaucagaucaauggcaaacugaacagauugauugguaagaccaacgaaaaauuccaccagaucgagaaggaauuuuccgagguugaagggaggauccaagaccucgagaaguacguggaggauacgaaaauugaccuguggucuuauaaugcagaauuacugguagcucucgagaaccagcauaccauagaucuuacagacagcgaaaugaauaagcuguucgagaaaacuaagaaacaguugcgggaaaacgccgaggauaugggcaauggaugcuuuaagaucuaccacaagugugacaacgcuugcauuggcucaauccgaaaugggaccuaugaucaugacguguaccgcgacgaggcccuaaacaauagauuccagauuaaaggagucgaacugaagagugguuacaaagauuggauccucuggauauccuuugcaaucagcugcuuccugcuuuguguggcccuguugggcuuuauuaugugggcuugccaaaaggggaacaucagguguaauauuugcaucuga

SEQ ID NO: 126700 - RNA, 1701 nt, Artificial Sequence
  derived and/or modified sequence opt3 from hemagglutinin__InfluenzaA__ADG21017
augaagaccaucauugcccugagcuacauacucuaucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucaucgagagauccaaagccuacucuaauugcuaucccuacgacgugccugauuaugcaucguugaggucacucgucgccagcaguggcacucuggaauuuaacaaugaguccuucaacuggacaggugugacccagaaugggacgucuagcgcuuguauucggcgcuccaacaauucauuuuucagucgacugaacuggcucacucauuuaaauuuuaaguacccagcacugaacguuaccaugcccaacaaugagcaguucgacaagcuguauaucuggggagugcaccauccuggcacagauaaagaccagauuuuucuuuacgcccaagcuagcggccguaucacugucucuaccaagagaucccagcaggccgugauaccaaacauugggucaaggccccggguacgcaauaucccuagcagaauuaguaucuacuggacaaucguuaaaccaggagauauucugcuaauaaacucuaccgguaaucucaucgcgccgaggggcuauuucaagauucgguccgggaaaagcucgaucaugcgcucugacgcacccauaggaaagugcaacuccgaauguauuacgccuaauggcucaaucccaaacgacaagcccuuucagaaugugaaccgaaucacuuacggugccugcccuagauaugucaaacaaaauacacugaaguuggcuaccgggaugaggaacgugccagagaaacagacucggggaauuuucggcgccaucgcaggcuuuauugaaaaugggugggagggaaugguggaugguugguacggcuuccgucaccagaacagugaggggcgcggacaagcugccgaccuuaagagcacacaggcggccauagaucagaucaauggcaaauugaacagacucauugguaagaccaacgaaaaauuccaccagaucgagaaggaauuuuccgaggucgaagggaggauccaagaccuggagaaguauguugaggauacgaaaauugacuuauggucuuacaaugcagaacugcucguggcucuugagaaccagcauaccauagaucugacagacagcgaaaugaauaaguuguucgagaaaacuaagaaacagcuacgggaaaacgccgaggauaugggcaauggauguuuuaagaucuaucacaagugcgacaacgcuuguauuggcucaauccgaaaugggaccuacgaucaugacguauaccgcgacgaggcccugaacaauagauuccagauuaaaggaguggaacucaagagugguuauaaagauuggauccuguggauauccuuugcaaucagcugcuuccuucugugcgucgccuugcucggcuuuauuaugugggcuugucaaaaggggaacaucaggugcaauauuuguaucuga

SEQ ID NO: 126701 - RNA, 1701 nt, Artificial Sequence
  derived and/or modified sequence opt3 from hemagglutinin__InfluenzaA__ADG21018
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaauuuuaaguauccagcauuaaacgugaccaugcccaacaaugagcaguucgacaagcuguacauuuggggaguccaccauccuggcacagauaaagaccagaucuuucuuuaugcccaggcuucuggccguauuacuguguccaccaagagaucacaacaggccguaaucccaaacauagggagcaggcaccggguucgcaauauucccaguagaaucucuauuuacuggacaaucgugaaaccuggagauaucuugcugauuaacuccaccgguaaucuaauagcgccaaggggcuacuucaagauccggagcgggaaaucgucuauuaugcgcuccgacgcaccgaucggaaaguguaacucagaaugcauaacgcccaauggcaguauuccuaacgacaagccauuucagaaugucaaccgaaucacuuauggugccugucccagauacgugaaacaaaauacacucaagcuggcuaccgggaugaggaacgugccugagaaacagacucggggaaucuucggcgccauugcaggcuuuaucgaaaaugggugggagggaauggucgaugguugguauggcuuccgucaccagaacagcgaggggcgcggacaagcugccgaccuuaaguccacacaggcggccauugaucagauaaauggcaaacugaacagauugaucgguaagaccaacgaaaaauuccaucagauugagaaggaauuuucugagguugaagggaggauccaagaccucgagaaguacguggaggauacgaaaaucgaccuguggagcuauaaugcagaauuacugguagcucucgagaaccagcacaccauugaucuuacagacucagaaaugaauaagcuguucgagaaaacuaagaaacaguugcgggaaaacgccgaggauaugggcaauggaugcuuuaagauauaccauaagugugacaacgcuugcaucggcaguauucgaaaugggaccuaugaucacgacguguaccgcgacgaggcccuaaacaauagauuccagaucaaaggagucgaacugaaguccgguuacaaagauuggauucucuggaucagcuuugcaauaucuugcuuccugcuuuguguggcccuguugggcuuuaucaugugggcuugccaaaaggggaacauuagguguaauaucugcauuuga

SEQ ID NO: 126702 - RNA, 1701 nt, Artificial Sequence
  derived and/or modified sequence opt3 from hemagglutinin__InfluenzaA__ADG21019
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacacucugcuuggggauccgcagugcgacggauuucaaaacaagaaaugggaucuguucguggaaagauccaaggcuuauucuaauuguuaccccuaugacgucccugauuacgccucguugaggucacucguggcaagcaguggcacacuggaguuuaacaaugaauccuucaacuggaccgguguuacgcagaaugggacuucuagcgccugcauccggcgcuccaagaacucauuuuucagucgacugaauuggcucacccauuuaaacuuuaaauauccagcucugaaugugacaaugcccaacaacgagcaguucgacaaacuuuacauuuggggaguccaccauccuggcacugauaaggaccagaucuuuuuguaugcacaagccagcggcaagauuaucgugucuaccaaacguucccagcagacaguaauaccaaauauugggucaagacccaggguucggaacaucccuagcauuaucaguaucuacuggaccauugugaagccaggagauauacugcuaaucaauucuacggguaaccucauugcuccgcgcggcuacuucaagaucagauccgggaaaagcucgauaaugaggucugacgcccccauuggaaaguguaauuccgagugcaucacuccuaacggcucaaucccaaaugacaaacccuuucagaacgucaaucggauuacauauggugcguguccucgcuacgugaagcaaaacacccugaaacuugcaacugggaugcgaaaugugccagaaaagcagacaagaggaaucuucggcgccauugcuggcuuuauagagaacgggugggaaggaauggucgaugguugguauggcuucaggcaccagaauagugaggggcggggacaagccgcagaccugaaaagcacccaggcugccaucgaucagauuaacggcaaguugaaucgucucaucgguaagacgaacgagaaauuccaccagaucgaaaaggaguuuuccgaaguugaggggcgcauucaagaccuggaaaaauacguggaggauaccaagauagacuuauggucuuauaacgcggagcugcucguagcccuugaaaaucagcauacaaucgaucugacugacagcgagaugaacaaauuguucgaaaagaccaagaaacagcuaagagagaaugcagaagauauuggcaacggaugcuuuaagaucuaccacaaaugugacaaugcuugcauuggcucaaucaggaacgggacauaugaucaugacguguaccgggacgaggcccugaauaaccgauuccagauaaagggagucgagcucaaaagugguuacaaggauuggauccuguggauuuccuuugcuaucagcugcuuccuucuguguguggccuugcucggcuuuauuaugugggcaugccaaaaggggaauauccgcuguaacauaugcauuuga

SEQ ID NO: 126703 - RNA, 1701 nt, Artificial Sequence
  derived and/or modified sequence opt3 from hemagglutinin__InfluenzaA__ADG21020
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagucugggacgagcuccgcuugcauccggcgcucaaagaauagcuuuuucagucgacugaacuggcucacucauuuaaauuuuaaauauccagcacugaacgugaccaugcccaauaacgagcaguucgacaaacuuuacauuuggggaguccaccauccuggcacagauaaagaccagaucuuuuuguaugcccaggcuucuggccguauuaucguguccacuaagagaucacaacagaccguaacaccaaacauagggagcaggccccggguucgcaauauuccuaguagaaucucuauuuacuggaccaucgugaaaccaggagauauccugcuaauuaacuccacggguaaucucauagccccgaggggcuacuucaagauccggagcgggaagucgucuauuaugcgcuccgacgcgcccaucggaaaauguaacucagagugcauaacuccuaauggcaguauuccaaacgacaagcccuuucagaaugucaaccgaaucacauauggugcauguccuagauacgugaaacaaaauacccugaaacuugccacugggaugaggaacgugccagaaaagcagacacggggaaucuucggcgcuauugccggcuuuaucgagaaugggugggaaggaauggucgaugguugguauggcuuccgucaccagaacagcgaggggcgcggacaagcagcugaccugaaguccacccaggccgcgauugaucagauaaauggcaaauugaacagacucaucgguaagacgaaugagaaguuccaccagauugaaaaagaguuuucugaaguugaggggaggauccaagaccuggaaaaguacguggaggauaccaaaaucgacuuauggagcuauaacgccgagcugcucguagcacuugaaaaccagcauacaauugaucugacugacucagagaugaauaaguuguucgaaaagaccaagaagcagcuacgggagaacgcugaagauaugggcaauggaugcuuuaaaauauaccacaagugugacaacgccugcaucggcaguauucgaaaugggacauaugaucaugacguguaccgcgacgaggcucugaacaauagauuccagaucaaaggagucgagcucaaguccgguuacaaagauuggauucuguggaucagcuuugccauaucuugcuuccuucuguguguggcauugcucggcuuuaucaugugggccugccaaaaggggaacauuagguguaauaucugcauuuga

SEQ ID NO: 126704 - RNA, 1701 nt, Artificial Sequence; identical to SEQ ID NO: 124450
  derived and/or modified sequence opt3 from hemagglutinin__InfluenzaA__ADG21022

SEQ ID NO: 126705 - RNA, 1701 nt, Artificial Sequence; identical to SEQ ID NO: 124450
  derived and/or modified sequence opt3 from hemagglutinin__InfluenzaA__ADG21023

SEQ ID NO: 126706 - RNA, 1701 nt, Artificial Sequence
  derived and/or modified sequence opt3 from hemagglutinin__InfluenzaA__ADG21024
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcgcccuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccaguccgggaaaagcucgauuaugcggucugacgcacccaucggaaaguguaacuccgaaugcauaacgccuaauggcucaauuccaaacgacaagcccuuucaaaaugucaaccgcaucacuuauggugccuguccucgauacgugaaacagaguacacugaaacuugcuaccgggaugagaaaugugccagagaagcagacuaggggaaucuucggcgccauugcaggcuuuaucgaaaacgggugggagggaauggucgaugguugguauggcuuccggcaccaaaauagcgaggggcguggacaggcugccgaccugaaguccacacaggcggccauugaucagauaaacggcaaauugaaucgccucaucgguaagaccaacgaaaaauuccaccaaauugagaaggaauuuucugagguugaagggagaauccaggaccuggagaaguacguggaggauacgaaaaucgacuuauggagcuauaacgcagaacugcucguagcucuugagaaucagcauaccauugaucugacagacucagaaaugaacaaguuguucgagaaaacuaagaaacagcuaagggaaaaugccgaggauaugggcaacggaugcuuuaagauauaccacaagugugacaaugcuugcaucggcaguauucggaacgggaccuaugaucaugacguguaccgagacgaggcccugaauaaccgcuuccaaaucaaaggagucgaacucaaguccgguuacaaagauuggauucuguggaucagcuuugcaauaucuugcuuccuucuguguguggccuugcucggcuuuaucaugugggcuugccagaaggggaauauuagauguaacaucugcauuuga

SEQ ID NO: 126707 - RNA, 1701 nt, Artificial Sequence
  derived and/or modified sequence opt3 from hemagglutinin__InfluenzaA__ADG21026
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggcugcggguucgcaauauucccagcagaaucaguauuuacuggacaaucgugaaaccuggagauauccuacucauuaacucuaccgguaaucugauagcgccaaggggcuacuucaagauccgguccgggaaaagcucgauuaugcgcucugacgcaccgaucggaaaguguaacuccgaaugcauaacgcccaauggcucaauuccuaacgacaagccauuucagaaugucaaccgaaucacuuauggugccugucccagauacgugaaacaaaguacacuuaagcuggcuaccgggaugaggaaugugccugagaaacagacucggggaaucuucggcgccauugcaggcuuuaucgaaaacgggugggagggaauggucgaugguugguauggcuuccgucaccagaauagcgaggggcgcggacaagcugccgacuugaaguccacacaggcggccauugaucagauaaacggcaaacucaauagacugaucgguaagaccaacgaaaaauuccaccagauugagaaggaauuuucugagguugaagggaggauccaagacuuagagaaguacguggaggauacgaaaaucgaccuguggagcuauaacgcagaacuccuuguagcucuggagaaucagcauaccauugauuugacagacucagaaaugaacaagcuauucgagaaaacuaagaaacagcugcgggaaaaugccgaggauaugggcaacggaugcuuuaccauauaccacaagugugacaaugcuugcaucggcaguauucgaaacgggacauaugaucauaauguguaccgcgacgaggcccucaacaauagauuccagaucaagggagucgaacugaaauccgguuacaaggacuggauucuuuggaucagcuuugcaauaucuugcuuccuguuguguguggcccuccugggcuuuaucaugugggcuugccaaaaagggaacauuagguguaauaucugcauuuga

SEQ ID NO: 126708 - RNA, 1701 nt, Artificial Sequence; identical to SEQ ID NO: 124685
  derived and/or modified sequence opt3 from hemagglutinin__InfluenzaA__ADG21037

SEQ ID NO: 126709 - RNA, 1701 nt, Artificial Sequence
  derived and/or modified sequence opt3 from hemagglutinin__InfluenzaA__ADG21038
augaaggccauccuggugguccuccuuuacaccuucgcuacagcagacgccgauacucugugcauuggcuaucacgcgaacaauagcacggacaccguugauacaguguuggagaagaacguaacugugacccauuccgucaauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126710 - RNA, 1701 nt, Artificial Sequence
  derived and/or modified sequence opt3 from hemagglutinin__InfluenzaA__ADG21040
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauguacacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccagggucuaucaaauucuggcuaucuacucuacaguggcgucaaguuugguucucgugguaagccugggagcaauuuccuuuuggaugugcucuaacgguucguuacagugccggauauguaucuga

SEQ ID NO: 126711 - RNA, 1701 nt, Artificial Sequence
  derived and/or modified sequence opt3 from hemagglutinin__InfluenzaA__ADG21041
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagaaaagaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaguccgugaaaaacggcaccuacgacuaucccaaguacagcgaagaggcaaaacugaauagagaggaaauugauggggucaaacuugagucuacaaggaucuaucaaauucuggccauauacucaaccguggcuaguagcuugguccucgugguuucccugggagcggugucuuuuuggaugugcucgaacgguagcuuacagugccggaucuguauuuga

SEQ ID NO: 126712 - RNA, 1701 nt, Artificial Sequence; identical to SEQ ID NO: 125786
  derived and/or modified sequence opt3 from hemagglutinin__InfluenzaA__ADG21042

SEQ ID NO: 126713 - RNA, 1701 nt, Artificial Sequence
  derived and/or modified sequence opt3 from hemagglutinin__InfluenzaA__ADG21043
augaaggccauccuggugguccuccuuuacaccuucacaacugcuaacgcagacacgcugugcguuggcuaucacgccaauaacagcaccgauacaguggacacuguauuggagaaaaaugugaccgucacacauuccgugaacuuacuggaagauaagcacaaugggaaacuauguaagcucagaggaguugcgccccugcaucuugguaaaugcaacauugcuggcuggauacuggggaauccugagugugaaucuuugucaaccgccaguagcugguccuacaucguggagacuucuucgucagacaacggaacaugcuauccaggcgauuuuauugacuacgaagaacucagggagcagcugagcagugucuccucuuucgaacgguuugagaucuucccgaagaccagcuccuggcccaaucacgauucaaacaagggugugacggcagccuguccucaugcuggggcaaaaaguuuuuauaagaaucugauuuggcucguaaagaagggaaacagcuacccaaaauuaucuaaguccuauaucaaugacaagggcaaagaaguucuggugcuuuggggcauacaccaccccucaacuagcgccgaucaacagaguuuguaccagaacgcugacgccuacgucuucguggggaccucucgcuauuccaagaaauuuaagccugagaucgcgauucgaccaaaagugcgugagcaggaaggaagaaugaauuacuauuggacacuggucgagcccggugauaagaucacuuucgaagcaaccggcaaccuaguugugccuagguacgccuuugcuauggagcggaacgccgggagcggaauuaucauaucggacacaccaguacaugauugcaauaccacgugucaaacuccgaaaggcgcaauuaacacaucucuccccuuccagaauauccacuccauuaccaucgguaagugcccuaaguaugugaaaucaacuaagcugcgccuugcuacagggcugagaaacgucccaaguauccagagcaggggauuguuuggcgccauugcgggcuucauagaagggggauggaccgguaugguggacggcugguacggguaucaucaccagaaugagcaaggauccggcuacgccgcagaccucaaaucuacgcagaacgcuaucgaugagauuaccaauaagguuaacagcgugaucgagaaaaugaauacacaguuuacugccgucgguaaggaguucaaccaccuggaaaagcggauagagaauuuaaacaaaaagguggacgauggguuccuggacauuuggaccuacaaugcugaacuccuuguacuguuggagaacgagcgcacacuagauuaucaugacucaaauguuaaaaaccuguacgaaaaggugcgaagucagcucaaaaacaaugccaaggagaucggcaacggauguuuugaguucuaucacaagugcgauaauacuuguauggaauccgucaaaaacggcaccuacgacuaucccaaguacagcgaagaggcaaaacugaauagagaggaaaucgauggggugaaacuugagucuacaaggauuuaucaaauccuggccauuuacucaaccgucgcuaguagcuuggugcucguugugucccugggagcgauaucuuuuuggaugugcucgaacgguagcuuacagugccggaucuguauuuga

SEQ ID NO: 126714 - RNA, 1701 nt, Artificial Sequence
  derived and/or modified sequence opt3 from hemagglutinin__InfluenzaA__ADG21045
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagaaaagaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaguccgugaaaaacggcaccuacgacuaucccaaguacagcgaagaggcaaaacugaauagagaggaaauugauggggucaaacuugagucuacaaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 126715 - RNA, 1701 nt, Artificial Sequence; identical to SEQ ID NO: 126714
  derived and/or modified sequence opt3 from hemagglutinin__InfluenzaA__ADG21046

SEQ ID NO: 126716 - RNA, 1701 nt, Artificial Sequence; identical to SEQ ID NO: 125849
  derived and/or modified sequence opt3 from hemagglutinin__InfluenzaA__ADG21048

SEQ ID NO: 126717 - RNA, 1701 nt, Artificial Sequence
  derived and/or modified sequence opt3 from hemagglutinin__InfluenzaA__ADG21049
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguaaucaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgucuaaaggcgcuaucaauacuucccucccguuccagaacauucaccccaucacaaucgguaagugcccuaaguauguaaaaucaaccaagcugcgccuugccacugggcugagaaauauuccaaguauacagagcaggggauuguuuggcgcgaucgccggcuucauugaagggggauggacagguaugguggacggcugguacggguaucaucaccagaacgaacaaggauccggcuacgcagcugaccucaaaucuacccagaaugccaucgaugagauaacgaacaaggucaauagcgugauugagaaaaugaacacccaguuuacagcuguugguaaggaguucaaucaccuggaaaagcggaucgaaaacuuaaauaaaaagguggacgauggguuccuggacaucuggacuuacaacgccgagcuccuuguccuguuggaaaaugagcgcacccuagauuaucaugacucaaacgugaaaaaccuguacgagaagguacgaagucagcucaaaaauaacgcaaaggaaauuggcaauggauguuuugaguucuaucacaagugcgauaacacauguauggaauccguuaaaaauggcacuuacgacuaucccaaguacagcgaggaagccaaacugaacagagaggagaucgauggggugaaacuugaaucuaccaggauuuaucaaauacuggcuaucuacucaacagucgcgaguagcuuggugcucgucgugucccugggagcaauuucuuuuuggaugugcucgaaugguagcuuacagugccggaucuguaucuga

SEQ ID NO: 126718 - RNA, 1701 nt, Artificial Sequence; identical to SEQ ID NO: 125038
  derived and/or modified sequence opt3 from hemagglutinin__InfluenzaA__ADG21122

SEQ ID NO: 126719 - RNA, 1701 nt, Artificial Sequence; identical to SEQ ID NO: 125849
  derived and/or modified sequence opt3 from hemagglutinin__InfluenzaA__ADG21123

SEQ ID NO: 126720 - RNA, 1701 nt, Artificial Sequence; identical to SEQ ID NO: 124685
  derived and/or modified sequence opt3 from hemagglutinin__InfluenzaA__ADG21124

SEQ ID NO: 126721 - RNA, 1701 nt, Artificial Sequence
  derived and/or modified sequence opt3 from hemagglutinin__InfluenzaA__ADG21125
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucaagcgguuugaaauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggagagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 126722 - RNA, 1701 nt, Artificial Sequence; identical to SEQ ID NO: 124672
  derived and/or modified sequence opt3 from hemagglutinin__InfluenzaA__ADG21126

SEQ ID NO: 126723 - RNA, 1701 nt, Artificial Sequence; identical to SEQ ID NO: 124672
  derived and/or modified sequence opt3 from hemagglutinin__InfluenzaA__ADG21127

SEQ ID NO: 126724 - RNA, 1701 nt, Artificial Sequence; identical to SEQ ID NO: 124672
  derived and/or modified sequence opt3 from hemagglutinin__InfluenzaA__ADG21128

SEQ ID NO: 126725 - RNA, 1701 nt, Artificial Sequence; identical to SEQ ID NO: 124672
  derived and/or modified sequence opt3 from hemagglutinin__InfluenzaA__ADG21129

SEQ ID NO: 126726 - RNA, 1701 nt, Artificial Sequence; identical to SEQ ID NO: 124685
  derived and/or modified sequence opt3 from hemagglutinin__InfluenzaA__ADG21130

SEQ ID NO: 126727 - RNA, 1701 nt, Artificial Sequence; identical to SEQ ID NO: 124672
  derived and/or modified sequence opt3 from hemagglutinin__InfluenzaA__ADG21131

SEQ ID NO: 126728 - RNA, 1701 nt, Artificial Sequence; identical to SEQ ID NO: 124672
  derived and/or modified sequence opt3 from hemagglutinin__InfluenzaA__ADG21132

SEQ ID NO: 126729 - RNA, 1701 nt, Artificial Sequence; identical to SEQ ID NO: 124672
  derived and/or modified sequence opt3 from hemagglutinin__InfluenzaA__ADG21133

SEQ ID NO: 126730 - RNA, 1701 nt, Artificial Sequence; identical to SEQ ID NO: 124672
  derived and/or modified sequence opt3 from hemagglutinin__InfluenzaA__ADG21134

SEQ ID NO: 126731 - RNA, 1701 nt, Artificial Sequence; identical to SEQ ID NO: 124672
  derived and/or modified sequence opt3 from hemagglutinin__InfluenzaA__ADG21135

SEQ ID NO: 126732 - RNA, 1701 nt, Artificial Sequence; identical to SEQ ID NO: 124672
  derived and/or modified sequence opt3 from hemagglutinin__InfluenzaA__ADG21136

SEQ ID NO: 126733 - RNA, 1701 nt, Artificial Sequence; identical to SEQ ID NO: 124672
  derived and/or modified sequence opt3 from hemagglutinin__InfluenzaA__ADG21137

SEQ ID NO: 126734 - RNA, 1701 nt, Artificial Sequence; identical to SEQ ID NO: 124672
  derived and/or modified sequence opt3 from hemagglutinin__InfluenzaA__ADG21138

SEQ ID NO: 126735 - RNA, 1701 nt, Artificial Sequence; identical to SEQ ID NO: 124672
  derived and/or modified sequence opt3 from hemagglutinin__InfluenzaA__ADG21139

SEQ ID NO: 126736 - RNA, 1701 nt, Artificial Sequence
  derived and/or modified sequence opt3 from hemagglutinin__InfluenzaA__ADG21140
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugaugcuuuggggcauccaccaccccucaacgagcgcugaucaacagaguuuguaccagaacgccgacgcguacguuuucguggggucuucccgcuauagcaagaaauuuaagccugagauugcaauccgaccaaaaguccgugaucaggagggaagaaugaauuacuauuggacucugguggaacccggugacaagauuaccuucgaggccacaggcaaccuaguggucccuagguacgcuuuugccauggaacggaacgcagggucgggaaucauaauuucugauacuccaguucaugacugcaauaccacaugucaaaccccgaaaggcgcuaucaacacgucccuccccuuccagaauauucacccuaucacuaucgguaagugcccaaaguaugugaaaucaacaaagcugcgccuugccaccgggcugagaaacguacccaguauucagagcaggggauuguuuggcgcgauagccggcuucaucgaagggggauggacugguaugguggacggcugguacggguaucaucaccagaaugaacaaggauccggcuacgcagcugaucucaaaucuacacagaacgccauugacgagaucaccaauaaggucaacagcgugauagagaaaaugaauacgcaguuuaccgcuguugguaaggaguucaaccaccuggaaaagcggauugaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaaucggcaacggauguuuugaguucuaucacaagugcgacaauaccuguauggaauccguuaaaaacggcacauacgauuauccuaaguacagcgaggaagccaaacugaauagagaggagauugacggggugaaacuugaaucuacuaggaucuaucaaauucuggcuauauacucaaccgucgcgaguagcuuggugcucgucgugucccugggagcaaucucuuuuuggaugugcucgaacgguagcuuacagugccggauuuguaucuga

SEQ ID NO: 126737 - RNA, 1701 nt, Artificial Sequence; identical to SEQ ID NO: 124672
  derived and/or modified sequence opt3 from hemagglutinin__InfluenzaA__ADG21141

SEQ ID NO: 126738 - RNA, 1701 nt, Artificial Sequence
  derived and/or modified sequence opt3 from hemagglutinin__InfluenzaA__ADG21142
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggaaaagaguuuuuauaagaaucugaucuggcucgugaaaaagggaaacagcuacccaaaauuaucuaaguccuauauaaaugacaagggcaaagagguacugguucuuuggggcauccaccaccccucaacgagcgccgaucaacagaguuuguaccagaacgcugacgccuacguguucgucgggucuucccgcuauagcaagaaauuuaagccugagauugcgauccgaccaaaagugcgugaucaggaaggaagaaugaauuacuauuggacucugguggagcccggugacaagauuaccuucgaagcaacaggcaaccuagucguuccuagguacgccuuugcuauggagcggaacgccgggucgggaaucauaauuucugauacuccagugcaugacugcaauaccacaugucaaaccccgaaaggcgcaaucaacacgucccuccccuuccagaauauucacccuaucacuaucgguaagugcccaaaguauguaaaaucaacaaagcugcgccuugcuaccgggcugagaaacgugcccaguauucagagcaggggauuguuuggcgccauagcgggcuucaucgaagggggauggacugguauggucgacggcugguacggguaucaucaccagaaugagcaaggauccggcuacgccgcagaucucaaaucuacacagaacgcuauugacgagaucaccaauaaggugaacagcguuauagagaaaaugaauacgcaguuuaccgccguggguaaggaguucaaccaccuggaaaagcggauugagaauuuaaacaaaaaggucgaugacggguuccuggauaucuggacauacaaugcugaacuccuugugcuguuggagaacgagcgcacucuagacuaucaugauucaaauguuaaaaaccuguacgaaaagguacgaagucagcucaaaaacaaugccaaggagaucggcaacggauguuuugaguucuaucacaagugcgacaauaccuguauggaauccgugaaaaacggcacauacgauuauccuaaguacagcgaagaggcaaaacugaauagagaggaaauugacggggucaaacuugagucuacuaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 126739 - RNA, 1701 nt, Artificial Sequence; identical to SEQ ID NO: 124672
  derived and/or modified sequence opt3 from hemagglutinin__InfluenzaA__ADG21143

SEQ ID NO: 126740 - RNA, 1701 nt, Artificial Sequence; identical to SEQ ID NO: 124672
  derived and/or modified sequence opt3 from hemagglutinin__InfluenzaA__ADG21144

SEQ ID NO: 126741 - RNA, 1701 nt, Artificial Sequence
  derived and/or modified sequence opt3 from hemagglutinin__InfluenzaA__ADG21145
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuauauccuauaucaaugacaagggcaaggaaguacugguucuuuggggcauucaccaccccucaacgagcgcugaucaacagaguuuguaccagaacgccgacgcguacguguucgucgggucuucccgcuauagcaaaaaguuuaaaccugagaucgcaauucgaccaaaggugcgugaucaggagggaagaaugaauuacuauuggacucugguggaacccggugacaaaaucaccuucgaggccacaggcaaccuagucguuccuagguacgcuuuugccauggaacggaacgcagggucgggaauaauuaucucugauacuccagugcaugacugcaauaccacaugucaaaccccgaagggcgcuauuaacacgucccuccccuuccagaauauccacccuaucacuauugguaaaugcccaaaguauguaaagucaacaaaacugcgccuugccaccgggcugagaaacgugcccaguauacagagcaggggauuguuuggcgcgaucgccggcuucauugaagggggauggacugguauggucgacggcugguacggguaucaucaccagaaugaacaaggauccggcuacgcagcugaucucaagucuacacagaacgccaucgacgagauaaccaauaaagugaacagcguuauugagaagaugaauacgcaguuuaccgcuguggguaaagaguucaaccaccuggaaaagcggaucgaaaauuuaaacaagaaagucgaugacggguuccuggauaucuggacauacaaugccgagcuccuugugcuguuggaaaacgagcgcacucuagacuaucaugauucaaauguaaagaaccuguacgagaaaguucgaagucagcucaagaacaaugcaaaagaaauuggcaacggauguuuugaguucuaucacaagugcgacaauaccuguauggaauccgugaagaacggcacauacgauuauccuaaauacagcgaggaagccaagcugaauagagaggagaucgacggggucaaacuugaaucuacuaggauuuaucaaauacuggcuaucuacucaaccguggcgaguagcuugguccucgugguuucccugggagcaauuucuuuuuggaugugcucgaacgguagcuuacagugccggaucuguaucuga

SEQ ID NO: 126742 - RNA, 1701 nt, Artificial Sequence; identical to SEQ ID NO: 124672
  derived and/or modified sequence opt3 from hemagglutinin__InfluenzaA__ADG21146

SEQ ID NO: 126743 - RNA, 1701 nt, Artificial Sequence; identical to SEQ ID NO: 124672
  derived and/or modified sequence opt3 from hemagglutinin__InfluenzaA__ADG21147

SEQ ID NO: 126744 - RNA, 1701 nt, Artificial Sequence; identical to SEQ ID NO: 124685
  derived and/or modified sequence opt3 from hemagglutinin__InfluenzaA__ADG21148

SEQ ID NO: 126745 - RNA, 1701 nt, Artificial Sequence; identical to SEQ ID NO: 125786
  derived and/or modified sequence opt3 from hemagglutinin__InfluenzaA__ADG21149

SEQ ID NO: 126746 - RNA, 1701 nt, Artificial Sequence; identical to SEQ ID NO: 125849
  derived and/or modified sequence opt3 from hemagglutinin__InfluenzaA__ADG21150

SEQ ID NO: 126747 - RNA, 1701 nt, Artificial Sequence; identical to SEQ ID NO: 124672
  derived and/or modified sequence opt3 from hemagglutinin__InfluenzaA__ADG21151

SEQ ID NO: 126748 - RNA, 1701 nt, Artificial Sequence; identical to SEQ ID NO: 124672
  derived and/or modified sequence opt3 from hemagglutinin__InfluenzaA__ADG21152

SEQ ID NO: 126749 - RNA, 1701 nt, Artificial Sequence; identical to SEQ ID NO: 124685
  derived and/or modified sequence opt3 from hemagglutinin__InfluenzaA__ADG21153

SEQ ID NO: 126750 - RNA, 1701 nt, Artificial Sequence; identical to SEQ ID NO: 124672
  derived and/or modified sequence opt3 from hemagglutinin__InfluenzaA__ADG21154

SEQ ID NO: 126751 - RNA, 1701 nt, Artificial Sequence; identical to SEQ ID NO: 124672
  derived and/or modified sequence opt3 from hemagglutinin__InfluenzaA__ADG21155

SEQ ID NO: 126752 - RNA, 1701 nt, Artificial Sequence; identical to SEQ ID NO: 125849
  derived and/or modified sequence opt3 from hemagglutinin__InfluenzaA__ADG21156

SEQ ID NO: 126753 - RNA, 1701 nt, Artificial Sequence; identical to SEQ ID NO: 125857
  derived and/or modified sequence opt3 from hemagglutinin__InfluenzaA__ADG21158

SEQ ID NO: 126754 - RNA, 1701 nt, Artificial Sequence
  derived and/or modified sequence opt3 from hemagglutinin__InfluenzaA__ADG21159
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccuccuggugagcuuaggagcaaucuccuuuuggaugugcucuaacgguucgcugcagugccggauuuguaucuga

SEQ ID NO: 126755 - RNA, 1701 nt, Artificial Sequence; identical to SEQ ID NO: 125857
  derived and/or modified sequence opt3 from hemagglutinin__InfluenzaA__ADG21160

SEQ ID NO: 126756 - RNA, 1701 nt, Artificial Sequence
  derived and/or modified sequence opt3 from hemagglutinin__InfluenzaA__ADG21161
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucauaauagcaacguuaaaaaccuguacgaaaagguacgaucacagcucaaaaauaacgcaaaggagaucgggaauggcuguuuugaguucuaucacaagugcgauaacacauguauggagagugugaaaaauggaacuuacgacuauccuaaguacuccgaagaggccaaacugaacagagaggaaauugauggcgucaaacuugagagcaccaggaucuaucaaauucuggcuauauacucuacaguggcgucaaguuugguccucgugguuagccugggggcaaucuccuuuuggaugugcucuaauggaucguuacagugccggauuuguaucuga

SEQ ID NO: 126757 - RNA, 1701 nt, Artificial Sequence
  derived and/or modified sequence opt3 from hemagglutinin__InfluenzaA__ADG21163
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauguacacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauguauggacuuacaaugccgagcuccuuguucuguuggaaaacgagcgcacccuagacuaucaugauagcaaugugaaaaaccuguacgagaagguccgaucacagcucaaaaacaaugcaaaggaaauuggcaacggauguuuugaguucuaucacaagugcgacaauacauguauggaaagugugaaaaacggcacuuacgauuauccuaaguacuccgaggaagccaaacugaauagagaggagaucgacggggucaaacuugaaagcaccaggaucuaucaaauucuggcuaucuacucuacaguggcgucaaguuugguucucgugguaagccugggagcaauuuccuuuuggaugugcucuaacgguucguuacagugccggauauguaucuga

SEQ ID NO: 126758 - RNA, 1701 nt, Artificial Sequence
  derived and/or modified sequence opt3 from hemagglutinin__InfluenzaA__ADG21165
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggaacucagggagcagcugagcaguguuuccucuuucaagcgguuugaaaucuucccgaagacaaauagcuggcccaaccacgauuccaauaaaggugugaccgccgcuuguccucaugcaggggccaagucauuuuauaaaaaccugauauggcucgucaagaaaggaaauaguuacccaaaguuaagcaagucuuauaucaacgacaaaggcaaggaggugcugguacuuuggggcauucaccaccccuccacgucagcugaucaacagagcuuguaccagaaugccgacgcguacguuuucguggggaccaguaaauauucuaagaaauuuaagccugaaaucgcaauucgcccaaaaguccgagaucaggagggacguaugaacuacuauuggacucugguggagcccggugacaagaucacauucgaagccacuggcaaccuaguggucccuagauacgcuuuugccauggagaggaaugcaggguccggaauaauuaucagcgauaccccaguucaugacugcaacacaaccugucaaacgccgaagggcgcuauuaauacuucgcuccccuuccagaacauccacccuaucacaauugguaaaugcccaaaguaugugaaaucuaccaagcugcggcuugccacugggcugcgcaauguacccuccauacagucaagaggauuguuuggcgcgaucgccggcuucauugaagggggauggacagguaugguggacggcugguacggguaucaucaccagaacgagcaaggaaguggcuacgcagcugaucucaaaagcacccagaaugccaucgacgguauaacgaacaaggucaauuccgugauugaaaagaugaacacccaguuuacagcuguugggaaagaguucaaucaccuggagaagaggaucgaaaacuuaaauaaaaagguggaugacggcuuccuggauaucuggacuuacaacgccgagcuccuuguccuguuggaaaaugagcggacccuagacuaucaugauucuaacgugaaaaaccuguacgaaaagguacgcagccagcucaagaauaacgcaaaagagauuggaaauggcuguuuugaguucuaucacaagugcgacaacacauguauggaaucaguuaaaaaugggacuuacgauuauccuaaguacagugaggaagccaaacugaaccgagaggaaaucgacggagugaaacuugaguccaccagaauuuaucaaauacuggcuaucuacagcacagucgcgucuucauuggugcucgucgugagucugggugcaauuagcuuuuggaugugcuccaauggcucuuuacagugcaggaucuguaucuga

SEQ ID NO: 126759 - RNA, 1701 nt, Artificial Sequence; identical to SEQ ID NO: 124672
  derived and/or modified sequence opt3 from hemagglutinin__InfluenzaA__ADG21166

SEQ ID NO: 126760 - RNA, 1701 nt, Artificial Sequence
  derived and/or modified sequence opt3 from hemagglutinin__InfluenzaA__ADG21168
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguucuauauaaaugacaagggcaaagaaguacugguucuuuggggcauccaccaccccuccacgucagcugaucaacagagcuuguaccagaacgccgacgcguacguguuugucgggaguucucgcuauuccaagaaauucaagccugagauugcaauccgaccaaaagugcgugaucaggagggaagaaugaauuacuauuggacucugguggaacccggugacaagauuaccuuugaggccacaggcaaccuagucguuccuagguacgcuuucgccauggaacggaacgcagggagcggaaucauaauuucggauacuccagugcaugacugcaauaccacaugucaaaccccgaaaggcgcuaucaacacgucucuccccuuucagaauauucacccuaucacuaucgguaagugcccaaaguauguaaaauccacaaagcugcgccuugccaccgggcugagaaacgugcccucaauucagaguaggggauuguucggcgcgauagccggcuuuaucgaagggggauggacugguauggucgacggcugguacggguaucaucaccagaaugaacaaggaagcggcuacgcagcugaucucaaauccacacagaacgccauugacgagaucaccaauaaggugaacucuguuauagagaaaaugaauacgcaguucaccgcuguggguaaggaguucaaccaccuggaaaagcggauugaaaauuuaaacaaaaaggucgaugacggguuucuggauaucuggacauacaaugccgagcuccuugugcuguuggaaaacgagcgcacucuagacuaucaugauagcaauguaaagaaccuguacgagaagguucgaucacagcucaaaaacaaugcaaaggaaaucggcaacggauguuucgaguuuuaucacaagugcgacaauaccuguauggaaagugugaaaaacggcacauacgauuauccuaaguacuccgaggaagccaaacugaauagagaggagauugacggggucaaacuugaaagcacuaggaucuaucaaauucuggcuauauacucuaccguggcgucaaguuugguccucgugguuagccugggagcaaucuccuucuggaugugcucuaacgguucguuacagugccggauuuguaucuga

SEQ ID NO: 126761 - RNA, 1701 nt, Artificial Sequence; identical to SEQ ID NO: 126714
  derived and/or modified sequence opt3 from hemagglutinin__InfluenzaA__ADG21169

SEQ ID NO: 126762 - RNA, 1701 nt, Artificial Sequence; identical to SEQ ID NO: 124672
  derived and/or modified sequence opt3 from hemagglutinin__InfluenzaA__ADG21170

SEQ ID NO: 126763 - RNA, 1701 nt, Artificial Sequence; identical to SEQ ID NO: 124672
  derived and/or modified sequence opt3 from hemagglutinin__InfluenzaA__ADG21173

SEQ ID NO: 126764 - RNA, 1701 nt, Artificial Sequence; identical to SEQ ID NO: 124685
  derived and/or modified sequence opt3 from hemagglutinin__InfluenzaA__ADG21174

SEQ ID NO: 126765 - RNA, 1701 nt, Artificial Sequence; identical to SEQ ID NO: 124685
  derived and/or modified sequence opt3 from hemagglutinin__InfluenzaA__ADG21175

SEQ ID NO: 126766 - RNA, 1701 nt, Artificial Sequence; identical to SEQ ID NO: 124672
  derived and/or modified sequence opt3 from hemagglutinin__InfluenzaA__ADG21176

SEQ ID NO: 126767 - RNA, 1701 nt, Artificial Sequence; identical to SEQ ID NO: 124672
  derived and/or modified sequence opt3 from hemagglutinin__InfluenzaA__ADG21177

SEQ ID NO: 126768 - RNA, 1701 nt, Artificial Sequence; identical to SEQ ID NO: 124672
  derived and/or modified sequence opt3 from hemagglutinin__InfluenzaA__ADG21178

SEQ ID NO: 126769 - RNA, 1701 nt, Artificial Sequence; identical to SEQ ID NO: 125038
  derived and/or modified sequence opt3 from hemagglutinin__InfluenzaA__ADG21179

SEQ ID NO: 126770 - RNA, 1701 nt, Artificial Sequence; identical to SEQ ID NO: 124672
  derived and/or modified sequence opt3 from hemagglutinin__InfluenzaA__ADG21180

SEQ ID NO: 126771 - RNA, 1701 nt, Artificial Sequence; identical to SEQ ID NO: 124672
  derived and/or modified sequence opt3 from hemagglutinin__InfluenzaA__ADG21181

SEQ ID NO: 126772 - RNA, 1701 nt, Artificial Sequence; identical to SEQ ID NO: 124672
  derived and/or modified sequence opt3 from hemagglutinin__InfluenzaA__ADG21182

SEQ ID NO: 126773 - RNA, 1701 nt, Artificial Sequence; identical to SEQ ID NO: 124672
  derived and/or modified sequence opt3 from hemagglutinin__InfluenzaA__ADG21183

SEQ ID NO: 126774 - RNA, 1701 nt, Artificial Sequence; identical to SEQ ID NO: 125849
  derived and/or modified sequence opt3 from hemagglutinin__InfluenzaA__ADG21184

SEQ ID NO: 126775 - RNA, 1701 nt, Artificial Sequence
  derived and/or modified sequence opt3 from hemagglutinin__InfluenzaA__ADG21185
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggugaagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucggucgcugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugagcaaggaagcggcuacgcagcugaucucaaauccacccagaacgccauugacgaaaucacgaauaaggugaacucuguuauagagaaaaugaauacccaguuuacagcuguggguaaggaguucaaccaccuggaaaagcgcauugagaauuuaaacaaaaaggucgaugacggguuccuggauaucuggacuuacaaugccgaacuccuugugcuguuggagaacgaacgaacccuagacuaucaugauagcaauguaaagaaccuguacgagaagguuagaucacagcucaaaaacaaugcaaaggagaucggcaacggauguuuugaguucuaucacaagugcgacaauacauguauggagagugugaaaaacggcacuuacgauuauccuaaguacuccgaagaggccaaacugaauagggaagagauugacggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 126776 - RNA, 1701 nt, Artificial Sequence; identical to SEQ ID NO: 126031
  derived and/or modified sequence opt3 from hemagglutinin__InfluenzaA__ADG21188

SEQ ID NO: 126777 - RNA, 1707 nt, Artificial Sequence
  derived and/or modified sequence opt3 from hemagglutinin__InfluenzaA__ADG21402
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaaggacaacgcauaucccacaauaaaacgauccuacaauaacacuaaucaagaggauuuacugguucuuugggguauucaccacccuaacgacgccgcugagcagacccguuuguaucagaacccaacaaccuacaucucaguggggacuucaacacugaaucagaggcuaguccccaagauugcaaccagaagcaaggugaacggacaaucuggccggauggaauuuuucuggacgauccucaaauccaaugaugccaucaacuuugagucaaauggcaacuucauugcuccugaaaaugccuacaagauagugaaaaagggggacagcacuaucaugaaaagugagcuggaauauggaaacugcaauaccaagugucagacaccaauuggugcgaucaacucuuccaugccguuucauaauauacacccccuuacuauuggcgagugcccuaaauacgucaagagcaaccgccugaucuuggcaaccgggcucagaaauucgccacagggagagaggcggcgcaagaaacgaggccuguucggugccaucgcuggguuuauugaaggaggcuggcagggcaugguugacgggugguauggauaccaucacucuaacgagcaagguuccggcuaugccgcagauaaggaaucaacacagaaagcuaucgacggggugaccaauaagguaaacaguauuauagauaaaaugaacacgcaguucgaggccgugggaagagaauuuaauaacuuagagaggcggaucgagaaucugaacaagaagauggaagacggcuuccucgaugucuggacuuacaaugcggagcuucugguguugauggaaaacgagcguacacuagacuuccacgauagcaauguuaaaaaccuguaugacaaggugcgccuccaacugagagauaaugccaaagaacuugguaacggguguuuugaguucuaccauaggugcgacaaugaguguauggaauccguccggaacggcaccuacgauuauccccaguacucugaggaagcacgacugaagcgcgaggagauuagcggagugaaauuggaaucaaucggcacuuaucagauccucaguauuuacuccacaguagcuagcucucuggccuuagcuauaaugguugccgggcuguuucuauggaugugcucaaauggaagucuccagugcagaaucuguauuuga

SEQ ID NO: 126778 - RNA, 1704 nt, Artificial Sequence
  derived and/or modified sequence opt3 from hemagglutinin__InfluenzaA__ADG21414
auggagaagaucgugcugcuccuugccauugucagcauaguuaaauccgaccagaucugcauuggcuaccacgcuaacaauucuaccgaacauguggauacaaucauggagaagaacguaacugugacgcacgcacaagacauucuggaaaagacccauaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaccuccugagcaggauuaaucauuucgagaaaauccagauuaucccuaagaacuccuggucugaccacgaggcuucgggagucucaagcgccuguccauaccagggccggaguuccuuuuuccgcaaugugguauggcugacuaaaaagaacaaugcauaucccacaauuaaaaagucuuacaacaacaccaaucaggaagaucucuuaguucugugggguauacaccauccuaacgacggggccgagcaaacacgacuuuaucagaauccaaccacuuacaucagcgugggaacauccaccuugaaccagcgucugguccccaagauugcuacgagaucaaaagugaauggccagaguggcaggauggaauuuuucuggacuauccuaaagagcaacgaugcaaucaauuuugagucuaacgggaauuucauugccccugaaaacgcuuacaaaauagugaagaaaggagacuccaccaucaugaagucagagcucgaauaugguaauugcaacacaaaaugucaaacuccaauuggcgccaucaauagcaguaugccguuucacaacauacauccccugaccauuggggagugcccuaaguacgucaagucuaaucggcuuguucuggcgacaggauugcgcaacuccccacagggcgagagaaggcggaaaaagcgcggucucuucggggcaaucgccggauuuaucgaaggcggcuggcaggggaugguggauggaugguaugguuaccaccacagcaacgagcagggcucgggguaugcugccgacaaagaaucuacccaaaaggcaauugacggaguaacgaauaaagugaacuccaucauugauaagaugaauacucaguucgaggcugucggccgagaauuuaacaaucuggagagaaggauagagaacuuaaauaagaaaauggaagacgguuuccuggauguguggacauacaacgccgagcuccuuguucugauggaaaaugagcggaccuuggacuuccaugauucaaacgugaagaaucuauaugacaaaguccgucugcagcuccgcgauaacgcgaaggaacuggggaauggcuguuuugaguucuaccacagaugcgacaacgaguguauggaaagugugaggaauggaacuuacgauuauccccaauacagcgaggaagcccggcuuaaacgagaggagaucuccggcguaaagcuggaaucuauugggacauaucagaucuugagcaucuacucaaccguugcaaguucccucgcucuggccauuaugguggcuggauuauuucuguggaugugcagcaacgguucucuacagugccgcauauguaucuga

SEQ ID NO: 126779 - RNA, 1704 nt, Artificial Sequence
  derived and/or modified sequence opt3 from hemagglutinin__InfluenzaA__ADG21416
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaagaacuccuggucugaccaugaggcuucgggagucucaagcgccuguccauaccagggccggaguuccuuuuuccgcaaugugguauggcugacuaaaaagaacaaugcauaucccacaauuaaaaagucuuacaacaacaccaaucaagaagaucucuuaguucugugggguauacaccacccuaacgacgccgcugagcagacagggcuuuaucagaauccaaccacuuacaucagcgugggaacauccaccuugaaccagcgacugguccccaagauugcaacgcguucaaaagugaauggccaaaguggcagaauggaauuuuucuggacuauccuaaagagcaacgaugugaucaauuuugagucuaacgggaauuucauugccccugaaaacgcuuacaaaauagucaagaaaggagacuccaccaucaugaagucagagcucgaauaugguaauugcaacacaaaaugucagacuccaauuggcgccaucaauagcaguaugccguuucauaacauacacccccugaccauuggggagugcccuaaguacguuaagucuaauaggcuugugcuggcgacaggauugcggaacuccccacagggcgagcgcagaaggaaaaagcggggucucuucggggcaaucgccggauuuaucgaaggcggcuggcaggggaugguagauggaugguaugguuaccaucacagcaacgagcaaggcucgggguaugcugccgacaaagaaucuacccagaaggcaauugacggagugacgaauaaagucaacuccaucauugauaagaugaauacucaguucgaggcugugggccgcgaauuuaacaaucuggagcgaagaauagagaacuuaaauaagaaaauggaagacgguuuccuggauguuuggacauacaacgccgagcuccuugugcugauggaaaaugagaggaccuuggacuuccacgauucaaacgucaagaaucuauaugacaaagugcggcugcaacuccgugauaacgcgaaggaacuggggaauggcuguuuugaguucuaccaucgcugcgacaacgaguguauggaaaguguaagaaauggaacuuacgauuauccccaguacagcgaggaagccaggcuuaaacgggaggagaucuccggcguuaagcuggaaucuauugggacauaucagaucuugagcaucuacucaaccguggcaaguucccucgcucuggccauuauggucgcuggauuauuucuguggaugugcagcaacgguucucuacagugccgaauauguaucuga

SEQ ID NO: 126780 - RNA, 1704 nt, Artificial Sequence
  derived and/or modified sequence opt3 from hemagglutinin__InfluenzaA__ADG21420
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaagaacuccuggucugaccaugaggcuucgggagucucaagcgccuguccauaccagggccggaguuccuuuuuccgcaaugugguauggcugacuaaaaagaacaaugcauaucccacaauuaaaaagucuuacaacaacaccaaucaagaagaucucuuaguucugugggguauacaccacccuaacgacgccgcugagcagacacgacuuuaucagaauccaaccacuuacaucagcguggggacauccaccuugaaccagcgucugguccccaagauugcaacgagaucaaaagugaauggacaaaguggcaggauggaauuuuucuggacuauccuaaagagcaacgaugccaucaauuuugagucuaacggcaauuucauugcuccugaaaacgccuacaaaauagugaagaaaggggacuccaccaucaugaagucagagcucgaauauggaaauugcaacacaaaaugucagacuccaauuggugcgaucaauagcaguaugccguuucauaacauacacccccugaccauuggcgagugcccuaaguacgucaagucuaaucggcuuguucuggcaacaggguugcgcaacuccccacagggagagagaaggcggaaaaagcgcggccucuucggugccaucgcuggguuuaucgaaggaggcuggcagggcaugguggaugggugguauggauaccaucacagcaacgagcaagguucgggcuaugccgcagacaaagaaucuacccagaaggcuauugacgggguaacgaauaaagugaacuccaucauugauaagaugaauacucaguucgaggccgucggacgagaauuuaacaaucuggagagaaggauagagaacuuaaauaagaaaauggaagacggcuuccuggauguguggacauacaacgcggagcuccuuguucugauggaaaaugagcggaccuuggacuuccacgauucaaacgugaagaaucuauaugacaaaguccgucugcaacuccgcgauaacgccaaggaacuggguaauggguguuuugaguucuaccauagaugcgacaacgaguguauggaaagugugaggaauggcacuuacgauuauccccaguacagcgaggaagcacggcuuaaacgagaggagaucuccggaguaaagcuggaaucuauuggcacauaucagaucuugagcaucuacucaaccguugcuaguucccucgcccuggcuauuaugguggccggguuauuucuguggaugugcagcaacggaucucuacagugccgcauauguaucuga

SEQ ID NO: 126781 - RNA, 1704 nt, Artificial Sequence
  derived and/or modified sequence opt3 from hemagglutinin__InfluenzaA__ADG21422
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccgacaaacgacuugugcuaccccgggaauuuuaacgauuaugaggaacucaagcaucugcugagcaggaucaaucacuucgagaaaauucagaucauuccuaagaacuccuggucugaccaugaagcgucgggagucucaagcgcuuguccauaccagggccggaguuccuuuuuccgcaaugugguauggcucacuaaaaagaacaaugccuaucccaccaucaaacgaucuuacaacaacacaaaucaagaggauuuacugguucuuugggguauacaccacccuaacgacgcagccgagcagacccguuuguaucagaauccaacuacauacauuagcguggggaccuccacgcugaaccagaggcuaguccccaagaucgcuacuagaucaaaggugaauggacaaaguggccggauggaauuuuucuggaccauucucaaaagcaacgaugcaaucaauuuugagucuaacggcaauuucaucgccccugaaaacgcuuacaagauugugaaaaagggggacuccacaauaaugaaaucagagcuggaauauggaaauugcaacacuaagugucagaccccaaucggugccauuaauagcaguaugccguuucauaacauccacccccuuacaauaggcgagugcccuaaauacgucaagucuaaucgccugguuuuggcgaccgggcucagaaacuccccacagggagagaggcggcgcaagaaacgaggccuguucggugcaauugccggguuuaucgaaggaggcuggcagggcaugguggaugggugguauggauaccaucacagcaacgagcaagguucgggcuaugcugccgacaaggaaucuacgcagaaagcaaucgacgggguaacuaauaaggugaacuccauuaucgauaaaaugaauacacaguucgaggcugucggaagagaauuuaacaauuuagagaggcggauugagaaccugaauaagaagauggaagacggcuuccucgauguguggaccuacaacgccgagcuucugguuuugauggaaaaugagcguacucuagacuuccacgauucaaacgugaaaaaucuguaugacaagguccgccuccaacugagagauaacgcgaaagaacuugguaauggguguuuugaguucuaccauaggugcgacaacgaguguauggaaagugugcggaauggcacauacgauuauccccaguacagcgaggaagcccgauccaagcgcgaggagauaucuggaguaaaacuggaaagcaucggcaccuaucagauuuugucaaucuacaguacgguugcauccagccucgcucuggccaucaugguggcuggguuauuucuguggaugugcucuaacggaucacuacagugcagaauuuguauauga

SEQ ID NO: 126782 - RNA, 1704 nt, Artificial Sequence
  derived and/or modified sequence opt3 from hemagglutinin__InfluenzaA__ADG21425
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccauggagcuucgggcgucucaagcgccuguccauaccagggucggaguuccuuuuuccgcaaugugguauggcucacuaaaaagaacaaugcauaucccacaaucaaaaagucuuacaacaacaccaaucaagaagauuuacugguucuuugggggauacaccacccuaacgacgccgaggagcagacacgauuguaucagaauccaaccacuuacauuagcgugggaacauccacccugaaccagcgucuaguccccaagaucgcuacgagaucaaaagugaauggccaaaguggcaggauggaauuuuucuggacuauucucaagagcaacgaugcaaucaauuuugagucuaacgggaauuucaucgccccugaaaacgcuuacaaaauugugaagaaaggagacuccaccauaaugaagucagagcuggaauaugauaauugcaacacaaaaugucagacuccaaucggugccauuaauagcaguaugccguuucauaacauccacccccuuaccauaggcgagugcccuaaguacgucaagucuaauaaacugguuuuggcgacagggcuccggaacuccccacagggagagaagcgcaggaaaaagagaggccuguucggugcaauugccggguuuaucgaaggaggcuggcagggcaugguggacgggugguauggauaccaucacagcaacgagcaagguucgggcuaugcugccgacaaagaaucuacccagaaggcaaucgaugggguaacgaauaaggugaacuccauuaucgacaaaaugaauacucaguucgaggcugucggacgggaauuuaacgccuuagagcgccgaauugagaaucugaacaagaaaauggaagauggcuuccucgacguguggacauacaaugcggagcuucugguuuugauggaaaacgagagaacccuagauuuccacgacucaaaugugaagaaccuguaugauaaagucaggcuccaacugcgggacaaugccaaggaacuugguaacggguguuuugaguucuaccaucguugcgauaaugaguguauggaaagugugcgcaacggcacuuacgacuauccccaguacagcgaggaagcaagacugaagagggaggagauauccggaguaaaauuggaaucuaucggcacauaucagauucucagcaucuacucaaccguugcuaguucccuggccuuagcuaucaugguggccgggcugagccuauggaugugcucuaauggaucacuccagugccggauuuguauauga

SEQ ID NO: 126783 - RNA, 1704 nt, Artificial Sequence
  derived and/or modified sequence opt3 from hemagglutinin__InfluenzaA__ADG21429
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggagaaaacccacaaugggaaguuguguaacuuagauggagucgaaccccugauccuaagagacugcucaguggccgguuggcuccugggcaauccuaugugugaugaguuccuuaacguuccagaauggaguuauauaguggagaaaaucaauccggcgaacgaccugugcuaccccgggaauuuuaacgauuaugaagaguugaagcaucuccugagcaggauuaaucacuucgaaaagauccagauuaucccuaaaaacuccuggucugaccaugaggcuucgggagucucaagcgccuguccauaccagggccggaguuccuuuuuccgcaaugugguauggcugacaaagaaaaacaaugcauaucccacuauaaagaaaucuuacaacaacaccaaucaagaggaucucuuaguucugugggguauucaccacccuaacgacgccgcugaacagacacgacuuuaucagaauccaaccacuuacaucagcguggggacauccaccuugaaccagcgucugguccccaagauugcaacgagaucaaaggugaauggacaaaguggcaggauggaguuuuucuggacuauccuaaaaagcaacgaugugaucaauuuugaaucuaacggcaauuucauugccccugagaacgcuuacaagauagucaaaaagggggacuccaccaucaugaaaucagaacucgaguauggaaauugcaacacaaagugucagacuccaauuggugccaucaauagcaguaugccguuucauaacauacacccccugaccauuggcgagugcccuaaauacguuaagucugaucggcuugugcuggcgacaggguugcgcaauuccccacagggagaaagaaggcggaagaaacgcggccucuucggugcaaucgccggguuuaucgagggaggcuggcagggcaugguagacgggugguauggauaccaucacagcaacgaacaagguucgggcuaugcugccgacaaggagucuacccagaaagcaauugauggggugacgaacaaggucaauuccaucauugacaaaaugaacacucaguucgaagcugugggacgagaguuuaauaaccuggagagaaggauagaaaauuuaaacaagaagauggaggauggcuuccuggacguuuggacauacaaugccgaacuccuugugcugauggagaacgaacggaccuuggauuuccacgacucaaaugucaaaaaccuauaugauaaggugcgucugcaacuccgcgacaaugcgaaagagcuggguaacggguguuuugaguucuaccauagaugcgauaaugaauguauggagaguguaaggaacggcacuuacgacuauccccaguacagcgaagaggcccggcuuaagcgagaggaaaucuccggaguuaaacuggagucuauuggcacauaucagaucuugagcaucuacucaaccguggcaaguucccucgcucuggccauuauggucgcuggguuacugcuauggaugugcagcaauggaucucuccagugccgcauauguaucuga

SEQ ID NO: 126784 - RNA, 1704 nt, Artificial Sequence
  derived and/or modified sequence opt3 from hemagglutinin__InfluenzaA__ADG21437
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaagaacuccuggucugaccaugaggcuucgggagucucaagcgccuguccauaccagggccggaguuccuuuuuccgcaaugugguauggcugacacagaaaaacaaugcauaucccacuauaaagaaaucuuacaacaacaccaaucaagaagaucucuuaguucugugggguauucaccacccuaacgacgccgcugagcagacacgacuuuaucagaauccaaccacuuacaucagcguggggacauccaccuugaaccaacgucugguccccaagauugcaacgagaucaaaggugaauggacagaguggcaggauggaauuuuucuggacuauccuaaaaagcaacgaugugaucaauuuugagucuaacggcaauuucauugccccugaaaacgcuuacaagauagucaaaaagggggacuccaccaucaugaaaucagagcucgaauauggaaauugcaacacaaagugucagacuccaauuggugccaucaauagcaguaugccguuucauaacauacacccccugaccauuggcgagugcccuaaauacguuaagucuaaucggcuugugcuggcgacaggguugcgcaacuccccacagggagagagaaggcggaagaaacgcggccucuucggugcaaucgccggguuuaucgaaggaggcuggcaaggcaugguagaugggugguauggauaccaucacagcaacgagcaggguucgggcuaugcugccgacaaggaaucuacccagaaagcaauugacggggugacgaauaaggucaacuccaucauugauaaaaugaauacucaauucgaggcugugggacgagaauuuaacaaucuggagagaaggauagagaacuuaaauaagaagauggaagacggcuuccuggauguuuggacauacaacgccgagcuccuugugcugauggaaaaugagcggaccuuggacuuccacgauucaaacgucaaaaaucuauaugacaaggugcgucugcagcuccgcgauaacgcgaaagaacuggguaauggguguuuugaguucuaccauagaugcgacaacgaguguauggaaaguguaaggaauggcacuuacgauuauccccaguacagcgaggaagcccggcuuaagcgagaggagaucuccggaguuaaacuggaaucuauuggcacauaucagaucuugagcaucuacucaaccguggcaaguucccucgcucuggccauuauggucgcuggguuauuucuguggaugugcagcaacggaucucuacaaugccgcauauguaucuga

SEQ ID NO: 126785 - RNA, 1704 nt, Artificial Sequence
  derived and/or modified sequence opt3 from hemagglutinin__InfluenzaA__ADG21439
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaagggauccuggucugaccaugaggcuucgggcgucucaagcgccuguccauaccagggucggaguuccuuuuuccgcaacgugguauggcugacuaaaaagaauaacgcauaucccacaauuaaaaagucuuacaauaacaccaaccaagaagaucucuuaguucugugggggauacaccacccuaaugacgccgcugagcagacacgacuuuaucagaacccaaccacuuacaucagcgugggaacauccaccuugaaucagcgucuggucccccaaauugcaacgagaucaaaggugaacggccagaguggcaggauggaauuuuucuggacuauccuaaaaagcaaugaugccaucaacuuugagucuaaugggaacuucauugcuccugaaaaugccuacaagauagugaaaaagggagacuccaccaucaugaaaucagagcucgaauaugguaacugcaauacaaagugucagacuccaauuggcgcgaucaacagcaguaugccguuucauaauauacacccccugaccauuggggagugcccuaaauacgucaagucuaaccggcuuguucuggcaacaggauugcgcaauuccccacagggcgagagaaggcggaagaaacgcggucucuucggggccaucgcuggauuuaucgaaggcggcuggcaagggaugguggauggaugguaugguuaccaucacagcaacgagcagggcucgggguaugccgcagacaaggaaucuacccagaaagcuauugacggaguaacgaacaaggucaauuccaucauugauaaaaugaacacucaauucgaggccgugggccgagaauuuaauaaccuggagagaaggauagagaauuuaaacaagaagauggaagacgguuuccuggauguguggacauacaaugcggagcuccuuguucugauggaaaacgagcggaccuuggacuuccacgauucaaaugugaaaaaccuauaugacaagguccgucugcagcuccgcgauaaugccaaagaacuggggaacggcuguuuugaguucuaccauagaugcgacaaugaguguauggaaagugugaggaacggaacuuacgauuauccccaguacagcgaggaagcacggcuuaagcgagaggagaucuccggcguaaaacuggaaucuauugggacauaucagaucuugagcaucuacucaaccguugcuaguucccucgcccuggcuauuaugguggccggauuauuucuguggaugugcagcaaugguucucuacaaugccgcauauguaucuga

SEQ ID NO: 126786 - RNA, 1704 nt, Artificial Sequence
  derived and/or modified sequence opt3 from hemagglutinin__InfluenzaA__ADG21441
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccgagcaacgaccugugcuaccccgggaauuuuaacgauuaugaggaauugaagcaucuccuguccaggauuaaucacuucgagaaaauccagauuaucccuaagaacucuuggucggaccaugaagcgucaggagucagcagugcuuguccauaccagggccgguccagcuuuuuccgcaaugugguauggcugacuaaaaagaacaaugccuaucccacaauuaaaaagucuuacaacaacaccaaucaagaggaucucuuaguucugugggguauacaccacccuaacgacgaggcagaacagacaucccuuuaucagaauccaaccacuuacaucucaguggggacaaguaccuugaaccagcgacugguccccaagauugccacgcguagcaaagugaauggacaaucuggcagaauggaguuuuucuggacuauccuaaaguccaacgaugcuaucaauuuugaaucaaacggcaauuucauugcaccugagaacgccuacaaaauagugaagaaaggggacagcaccaucaugaagagugaacucgaguauggaaauugcaacacaaaaugucagacuccaauuggugcuaucaauucuuccaugccguuucauaacauacacccccugaccauuggcgagugcccuaaguacgucaagagcaauaggcuuguucuggccacaggguugcggaacucgccacagggagaacgcagaaggaaaaagcggggccucuucggugcgaucgcaggguuuaucgagggaggcuggcagggcaugguggaugggugguauggauaccaucacucuaacgaacaagguuccggcuaugccgcugacaaagagucaacccagaaggccauugacgggguaacgaauaaagugaacaguaucauugauaagaugaauacucaguucgaagcagucggacgcgaguuuaacaaucuggagcgaagaauagaaaacuuaaauaagaaaauggaggacggcuuccuggauguguggacauacaacgcugaacuccuuguucugauggagaaugaaaggaccuuggacuuccacgauagcaacgugaagaaucuauaugacaaaguccggcugcaacuccgugauaacgccaaggagcuggguaauggguguuuugaguucuaccaucgcugcgacaacgaauguauggaguccgugagaaauggcacuuacgauuauccccaguacucugaagaggcgaggcuuaaacgggaggaaaucagcggaguaaagcuggagucaauuggcacauaucagaucuugaguaucuacuccaccguugccagcucucucgcacuggcuauuaugguggccggguuauuucuguggaugugcucaaacggaagucuacagugccgaauauguaucuga

SEQ ID NO: 126787 - RNA, 1704 nt, Artificial Sequence
  derived and/or modified sequence opt3 from hemagglutinin__InfluenzaA__ADG21443
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccgacaaacgaccugugcuaccccgggaauuuuaacgauuaugaggaauugaagcaucuccugagcaggauuaaucacuucgagaaaauccagauuaucccuaagaacuccuggucugaccaugaagcgucgggagucucaagcgcuuguccauaccagggccggaguuccuuuuuccgcaaugugguauggcugacuaaaaagaacaaugccuaucccaccauuaaaaagucuuacaacaacacaaaucaagaggaucucuuaguucugugggguauacaccacccuaacgacgcagccgagcagacccgacuuuaucagaauccaacuacauacaucagcguggggaccuccacguugaaccagcgucugguccccaagauugcuacuagaucaaaagugaauggacaaaguggcaggauggaauuuuucuggaccauccuaaagagcaacgaugcaaucaauuuugagucuaacggcaauuucauugccccugaaaacgcuuacaaaauagugaagaaaggggacuccacaaucaugaagucagagcucgaauauggaaauugcaacacuaaaugucagaccccaauuggugccaucaauagcaguaugccguuucauaacauacacccccugacaauuggcgagugcccuaaguacgucaagucuaaucggcuuguucuggcgaccggguugcgcaacuccccacagggagagagaaggcggaaaaagcgcggccucuucggugcaaucgccggguuuaucgaaggaggcuggcagggcaugguggaugggugguauggauaccaucacagcaacgagcaagguucgggcuaugcugccgacaaagaaucuacgcagaaggcaauugacgggguaacuaauaaagugaacuccaucauugauaagaugaauacacaguucgaggcugucggacgagaauuuaacaaucuggagagaaggauagagaacuuaaauaagaaaauggaagacggcuuccuggauguguggaccuacaacgccgagcuccuuguucugauggaaaaugagcggacuuuggacuuccacgauucaaacgugaagaaucuauaugacaaaguccgucugcaacuccgcgauaacgcgaaggaacuggguaauggguguuuugaguucuaccauagaugcgacaacgaguguauggaaagugugaggaauggcacauacgauuauccccaguacagcgaggaagcccggcuuaaacgagaggagaucuccggaguaaagcuggaaucuauuggcaccuaucagaucuugagcaucuacucaacgguugcaaguucccucgcucuggccauuaugguggcuggguuauuucuguggaugugcagcaacggaucucuacagugccgcauauguaucuga

SEQ ID NO: 126788 - RNA, 1704 nt, Artificial Sequence
  derived and/or modified sequence opt3 from hemagglutinin__InfluenzaA__ADG21445
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaguuguguaacuuagauggagucaaaccccugauccuaagagacugcucaguggccgguuggcuccugggcaauccuaugugugaugaguuccuuaacguuccagaauggaguuauauaguggagaagaucaauccgagcaacgaccugugcuaccccgggaauuuuaacgauuaugaggaauugaagcaucuccuguccaggauuaaucacuucgagaaaauccagauuaucccuaagaacucuuggucggaccaugaagcgucaggagucagcagugcuuguccauaccagggccgguccagcuuuuuccgcaaugugguauggcugacuaaaaagaacaaugccuaucccacaauuaaaaagucuuacaacaacaccaaucaagaggaucucuuaguucugugggguauacaccacccuaacgacgaggcagaacagacacgacuuuaucagaauccaaccacuuacaucuccguggggacaucaaccuugaaccagcgucugguccccaagauugccacgagaaguaaagugaauggacaaagcggcaggauggaguuuuucuggacuauccuaaagucuaacgaugcuaucaauuuugaauccaacggcaauuucauugcaccugagaacgccuacaaaauagugaagaaaggggacucaaccaucaugaaaagcgaacucgaguauggaaauugcaacacaaaaugucagacuccaauuggugcuaucaauaguucuaugccguuucauaacauacacccccugaccauuggcgagugcccuaaguacgucaaguccaaucggcuuguucuggccacaggguugcgcaacagcccacagggagaaagaaggcggaaaaagcgcggccucuucggugcgaucgcaggguuuaucgagggaggcuggcagggcaugguggaugggugguauggauaccaucacucgaacgaacaagguucuggcuaugccgcugacaaagaguccacccagaaggccauugacgggguaacgaauaaagugaacucaaucauugauaagaugaauacucaguucgaagcagucggacgagaguuuaacaaucuggagagaaggauagaaaacuuaaauaagaaaauggaggacggcuuccuggauguguggacauacaacgcugaacuccuuguucugauggagaaugaacggaccuuggacuuccacgauaguaacgugaagaaucuauaugacaaaguccgucugcaacuccgcgauaacgccaaggagcuggguaauggguguuuugaguucuaccauagaugcgacaacgaauguauggagagcgugaggaauggcacuuacgauuauccccaguacuccgaagaggcgcggcuuaaacgagaggaaaucucuggaguaaagcuggagagcauuggcacauaucagaucuugucaaucuacaguaccguugccuccagccucgcacuggcuauuaugguggccggguuauuucuguggaugugcucuaacggaucacuacagugccgcauauguaucuga

SEQ ID NO: 126789 - RNA, 1701 nt, Artificial Sequence; identical to SEQ ID NO: 124927
  derived and/or modified sequence opt3 from hemagglutinin__InfluenzaA__ADG21912

SEQ ID NO: 126790 - RNA, 1701 nt, Artificial Sequence; identical to SEQ ID NO: 124685
  derived and/or modified sequence opt3 from hemagglutinin__InfluenzaA__ADG21913

SEQ ID NO: 126791 - RNA, 1701 nt, Artificial Sequence
  derived and/or modified sequence opt3 from hemagglutinin__InfluenzaA__ADG21914
augaaggccaucauugugguccugcucuacaccuucgcuacagcaaacgccgacacucuuugcauaggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 126792 - RNA, 1701 nt, Artificial Sequence
  derived and/or modified sequence opt3 from hemagglutinin__InfluenzaA__ADG21915
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacauauuagaggauaaacacaaugggaagcuguguaaacuaagaggaguggcuccccuccaucuggguaagugcaacaucgccggcuggauucuugggaauccugaaugugagucucugucaacagcaaguagcugguccuacaucguugaaaccucuucgucagacaacggaacuugcuauccaggcgauuuuauugacuacgaggaguugagggaacagcucagcaguguguccucuuucgagcgguuugaaaucuucccgaaaacaagcuccuggcccaaucacgauucaaacaagggugucaccgccgcuuguccucaugcaggggccaagaguuuuuauaaaaaucugauauggcuggugaagaaaggaaacagcuacccaaagcucucuaaauccuauaucaaugacaagggcaaggagguauuaguucuguggggcauucaccaccccucaacgagcgcugaucaacagagucuuuaccagaacgccgacgcguacguguucgucgggucuucccgcuauagcaaaaaguuuaaaccugagaucgcaauucgaccaaaggugcgugaucaggaaggaagaaugaauuacuauuggacuuugguggagcccggugacaaaaucaccuucgaagccacaggcaaccuggucguuccuagguacgcuuuugccauagagcggaacgcagggucgggaauuaucauuucugauacuccagugcaugacugcaauaccacaugucaaaccccgaagggcgcuaucaacacgucccuacccuuccacaauauccauccuauuacuauagguaaaugcccaaaguauguaaagucaacaaaacuccgccuggccaccgggcuuagaaacgugcccaguauccagagcaggggacuguuuggcgcgauugccggcuucaucgaagggggauggacugguauggucgacggcugguacggguaucaccaccagaaugagcagggauccggcuacgcagcugauuugaagucuacacaaaacgccauagacgagauuaccaauaaagugaacagcguuaucgaaaagaugaauacgcaguuuaccgcuguggguaaagaguucaaccaucucgaaaagcggaucgagaaucugaacaagaaagucgaugacggguucuuagauauuuggacauacaaugccgaacugcucgugcuucuggagaacgagcgcacuuuggacuaucacgauucaaauguaaagaaccuauacgaaaaaguucgaagucagcugaagaacaaugcaaaagagaucggcaacggauguuuugaguucuaucauaagugcgacaauaccuguauggaauccgugaagaacggcacauacgauuauccuaaauacagcgaagaggccaagcucaauagagaggaaauugacggggucaaacuggagucuacuaggauauaucagauccuugcuauuuacucaaccguggcgaguagccuggucuuggugguuucccucggagcaaucucuuuuuggaugugcucgaacgguagccugcaaugccggaucuguauuuga

SEQ ID NO: 126793 - RNA, 1701 nt, Artificial Sequence; identical to SEQ ID NO: 124927
  derived and/or modified sequence opt3 from hemagglutinin__InfluenzaA__ADG21916

SEQ ID NO: 126794 - RNA, 1701 nt, Artificial Sequence; identical to SEQ ID NO: 124685
  derived and/or modified sequence opt3 from hemagglutinin__InfluenzaA__ADG21917

SEQ ID NO: 126795 - RNA, 1701 nt, Artificial Sequence; identical to SEQ ID NO: 126185
  derived and/or modified sequence opt3 from hemagglutinin__InfluenzaA__ADG21918

SEQ ID NO: 126796 - RNA, 1701 nt, Artificial Sequence
  derived and/or modified sequence opt3 from hemagglutinin__InfluenzaA__ADG21919
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaagaucgaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 126797 - RNA, 1701 nt, Artificial Sequence; identical to SEQ ID NO: 124927
  derived and/or modified sequence opt3 from hemagglutinin__InfluenzaA__ADG21921

SEQ ID NO: 126798 - RNA, 1701 nt, Artificial Sequence; identical to SEQ ID NO: 124685
  derived and/or modified sequence opt3 from hemagglutinin__InfluenzaA__ADG21922

SEQ ID NO: 126799 - RNA, 1701 nt, Artificial Sequence
  derived and/or modified sequence opt3 from hemagglutinin__InfluenzaA__ADG21923
augaaggccauccuggugguccuccuuuacaccuucgcuacagcaaacgccgacacucugugcauuggcuaucacgcgaauaacagcacggauaccguugacacaguguuggagaaaaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggucuuccaaguauagcaaaaaguuuaaaccugagauugccauccgcccaaagguccgagaucaggagggacguaugaauuacuauuggacucugguggaacccggugacaaaauuaccuucgaggcuacaggcaaccuaguggucccuagauacgccuuugcaauggaaaggaacgcugggucgggaaucauaauuucugauacuccaguucaugacugcaauaccacaugucaaaccccgaagggcgccaucaacacgucccuccccuuccacaauauucauccuaucacuaucgguaagugcccaaaauaugugaagucaacaaaacugcggcuugcgaccgggcugcgcaacguacccaguauucagagcagaggauuguuuggcgccauagcaggcuucaucgaagggggauggacugguaugguggacggcugguacggguaucaccaccagaaugaacagggauccggcuacgcugccgaucucaagucuacacaaaacgcuauugacgagaucaccaauaaagucaacagcgugauagagaagaugaauacgcaguuuaccgccguugguaaggaauuuaaccaucuggagaaaaggauugaaaauuuaaacaagaaaguggaugacggguuccuggauaucuggacauacaaugcagagcuccuuguccuguuggaaaacgagcggacucuagacuaucacgauucaaaugugaagaaccuguacgagaaaguacgcagucagcucaagaacaaugccaaggaaaucggcaacggauguuucgaguucuaucauaaaugcgacaauaccuguauggaauccguuaagaacggcacauacgauuauccuaaauacagcgaggaagcuaagcugaaucgagaggagauugacggggugaaacuugaaucuacuagaaucuaucagauucuggcgauauacucaaccgucgcaaguagcuuggugcucgucgugucccugggagccaucucuuuuuggaugugcucgaacgguagcuuacaaugcaggauuuguaucuga

SEQ ID NO: 126800 - RNA, 1701 nt, Artificial Sequence
  derived and/or modified sequence opt3 from hemagglutinin__InfluenzaA__ADG21924
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggagaauaaacacaacgggaagcuauguaaacucagaggaguggcuccccugcaucuugguaagugcaauauagccggcuggauccuggggaacccugaaugugagucuuugucaacagcaaguagcugguccuacauuguugaaaccucuucgucagauaauggaacuugcuauccaggcgacuuuaucgauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggucuucccgcuauagcaaaaaguuuaaaccugagauugcaauccgaccaaaggugcgugaccaggaaggaagaaugaacuacuauuggacucugguggagcccggugauaaaauuaccuucgaagccacaggcaaccuagucguuccuagguacgcuuuugccauggagcggaaugcagggucgggaaucauaauuucugacacuccagugcaugauugcaacaccacaugucaaaccccgaagggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgacggcugguacggguaucaccaccagaacgagcagggauccggcuacgcagcugaccucaagucuacacaaaaugccauugaugagaucaccaacaaagugaauagcguuauagaaaagaugaacacgcaguuuaccgcuguggguaaagaguucaaucaucuggaaaagcggauugagaacuuaaauaagaaagucgacgauggguuccuggacaucuggacauacaacgccgaacuccuugugcuguuggagaaugagcgcacucuagauuaucacgacucaaacguaaagaaccuguacgaaaaaguucgaagucagcucaagaauaacgcaaaagagaucggcaauggauguuuugaguucuaucauaagugcgauaacaccuguauggaauccgugaagaauggcacauacgacuauccuaaauacagcgaagaggccaagcugaacagagaggaaauugauggggucaaacuugagucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 126801 - RNA, 1701 nt, Artificial Sequence
  derived and/or modified sequence opt3 from hemagglutinin__InfluenzaA__ADG21925
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacgggaugcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguuaauucugugauagagaaaaugaacacccaguuuacagcuguggguaaggaguucaaucaccuggaaaagcggauugaaaacuuaaauaaaaagaucgacgauggguuccuggacaucuggacuuacaacgccgagcuccuuguccuguuggaaaaugagcgcacccuagauuaucaugacagcaacgugaaaaaucuguacgagaagguacgaucacagcucaaaaacaacgcaaaggaaauuggcaauggauguuuugaguucuaucacaagugcgauaacacauguauggaaaguguuaaaaauggcacuuacgacuauccuaaguacuccgaggaagccaaacugaacagagaggagaucgauggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126802 - RNA, 1701 nt, Artificial Sequence
  derived and/or modified sequence opt3 from hemagglutinin__InfluenzaA__ADG21926
augaaggccauccuggugguccuccuuuacaccuucgcuacagcaaacgccgacacucugugcauuggcuaucacgcgaauaacagcacggauaccguugacacaauauuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcaaucuagacuaucaugauagcaacgugaaaaaccuguacgagaagguacgaucacagcucaaaaauaacgcaaaggaaauuggcaauggauguuuugaguucuaucacaagugcgacaacaccuguauggaaaguguuaaaaauggcacauacgauuauccuaaguacuccgaggaagccaaacugaacagagaggagaucgacggggugaaacuugaaagcacuaggauuuaucaaauacuggcuaucuacucuaccgucgcgucaaguuuggugcucgucgugagccugggagcaauuuccuuuuggaugugcucuaaugguucguuacagugccggaucuguaucuga

SEQ ID NO: 126803 - RNA, 1701 nt, Artificial Sequence; identical to SEQ ID NO: 124927
  derived and/or modified sequence opt3 from hemagglutinin__InfluenzaA__ADG21927

SEQ ID NO: 126804 - RNA, 1701 nt, Artificial Sequence
  derived and/or modified sequence opt3 from hemagglutinin__InfluenzaA__ADG21928
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauugacuacgaggagcucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccacgugugagagaucaggagggaaggaugaauuacuauuggacacugguggaacccggugacaaaaucacuuucgaggccaccggcaaccuagucguuccucgguacgcuuuugccauggaacgcgaugcagggagcggaauuaucauaucggacacaccagugcaugacugcaacaccacgugucaaacuccgaagggcgcuauuaauacaucucuccccuuccagaacauccacccuauuaccaucgguaaaugcccaaaguauguaaaguccacuaaacugagacuugccacagggcugaggaaugugcccucaauccagagucggggauuguuuggcgcgauugccggcuucauagaagggggauggaccgguauggucgauggcugguacggguaucaucaccagaacgaacaaggaagcggcuacgcagcugaccucaaguccacgcagaaugccaucgaugagauuaccaacaaaguuaauucugugaucgagaagaugaacacacaguuuacugcuguggguaaagaguucaaucaccuggaaaagcgcauagaaaacuuaaauaagaaaauugacgauggguuccuggacaucuggaccuacaacgccgagcuccuuguccuguuggaaaaugagcgaacacuagauuaucaugacagcaacgugaagaaucuguacgagaaaguaagaucacagcucaagaacaacgcaaaagaaaucggcaauggauguuuugaguucuaucacaagugcgauaacacuuguauggaaaguguuaagaauggcaccuacgacuauccuaaauacuccgaggaagccaagcugaacagggaggagauugauggggugaaacuugaaagcacacggaucuaucaaauucuggcuauauacucuaccgucgcgucaaguuuggugcucgucgugagccugggagcaaucuccuuuuggaugugcucuaaugguucguuacagugccguauuuguaucuga

SEQ ID NO: 126805 - RNA, 1701 nt, Artificial Sequence; identical to SEQ ID NO: 126801
  derived and/or modified sequence opt3 from hemagglutinin__InfluenzaA__ADG21930

SEQ ID NO: 126806 - RNA, 1701 nt, Artificial Sequence; identical to SEQ ID NO: 124927
  derived and/or modified sequence opt3 from hemagglutinin__InfluenzaA__ADG21931

SEQ ID NO: 126807 - RNA, 1701 nt, Artificial Sequence; identical to SEQ ID NO: 124927
  derived and/or modified sequence opt3 from hemagglutinin__InfluenzaA__ADG21932

SEQ ID NO: 126808 - RNA, 1701 nt, Artificial Sequence; identical to SEQ ID NO: 124927
  derived and/or modified sequence opt3 from hemagglutinin__InfluenzaA__ADG21933

SEQ ID NO: 126809 - RNA, 1701 nt, Artificial Sequence; identical to SEQ ID NO: 126801
  derived and/or modified sequence opt3 from hemagglutinin__InfluenzaA__ADG21934

SEQ ID NO: 126810 - RNA, 1701 nt, Artificial Sequence
  derived and/or modified sequence opt3 from hemagglutinin__InfluenzaA__ADG21935
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccaacugucaaacaccgaauggcgcuaucaacaccucccuccccuuccacaauauucauccuaucacgaucgguaagugcccaaaauauguaaagucaacuaagcugcgccuugccacagggcugagaaacgugcccaguauucagagcaggggauuguuuggcgcgauagccggcuucaucgaagggggauggaccgguauggucgacggcugguacggguaucaccaccagaaugagcagggauccggcuacgcagcugaucucaaaucuacucaaaacgccauugacgagaucacaaauaaggugaacagcguuauagaaaagaugaauacccaguuuacggcuguggguaaggaguucaaccaucuggaaaaacggauugagaauuuaaacaagaaggucgaugacggguuccuggauaucuggaccuacaaugccgaacuccuugugcuguuggagaacgagcgcacacuagacuaucacgauucaaacguuaaaaaucuguacgaaaagguacgaagucagcucaaaaacaaugcaaaggagaucggcaacggauguuuugaguucuaucauaaaugcgacaauacuuguauggaauccgugaagaacggcaccuacgauuauccuaaguacagcgaagaggccaaacugaauagagaggaaauugacggggucaaacuugagucuacaaggaucuaucagauucuggcuauauacucaacuguggcgaguagcuugguccucgugguuucccugggagcaaucucuuuuuggaugugcucgaacgguagcuuacaaugccggauuuguaucuga

SEQ ID NO: 126811 - RNA, 1701 nt, Artificial Sequence; identical to SEQ ID NO: 124927
  derived and/or modified sequence opt3 from hemagglutinin__InfluenzaA__ADG21936

SEQ ID NO: 126812 - RNA, 1701 nt, Artificial Sequence; identical to SEQ ID NO: 124927
  derived and/or modified sequence opt3 from hemagglutinin__InfluenzaA__ADG21937

SEQ ID NO: 126813 - RNA, 1701 nt, Artificial Sequence
  derived and/or modified sequence opt3 from hemagglutinin__InfluenzaA__ADG21938
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcaaucuagacuaucacgauucaaacguaaagaaccuguacgaaaaaguucgaagucagcucaagaauaacgcaaaagagaucggcaauggauguuuugaguucuaucauaagugcgacaacacuuguauggaauccgugaagaauggcaccuacgauuauccuaaauacagcgaagaggccaagcugaacagagaggaaauugacggggucaaacuugagucuacaaggaucuaucagauucuggcuauauacucaacuguggcgaguagcuugguccucgugguuucccugggagcaaucucuuuuuggaugugcucgaaugguagcuuacaaugccggauuuguaucuga

SEQ ID NO: 126814 - RNA, 1701 nt, Artificial Sequence; identical to SEQ ID NO: 124927
  derived and/or modified sequence opt3 from hemagglutinin__InfluenzaA__ADG21939

SEQ ID NO: 126815 - RNA, 1701 nt, Artificial Sequence; identical to SEQ ID NO: 124927
  derived and/or modified sequence opt3 from hemagglutinin__InfluenzaA__ADG21940

SEQ ID NO: 126816 - RNA, 1701 nt, Artificial Sequence
  derived and/or modified sequence opt3 from hemagglutinin__InfluenzaA__ADG21941
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaaaucgaugacggguuccuggauaucuggacauacaaugccgaacuccuuguccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacaaugccggaucuguaucuga

SEQ ID NO: 126817 - RNA, 1701 nt, Artificial Sequence
  derived and/or modified sequence opt3 from hemagglutinin__InfluenzaA__ADG21943
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacgggaugcaggguccggaaucauaauuagcgacaccccagugcaugacugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgauggcugguacggguaucaucaccagaaugaacaaggaaguggcuacgcagcugaccucaaaagcacccagaacgccauugaugagaucacgaauaaggugaacuccguuauagagaaaaugaauacccaguuuacagcuguggguaaggaguucaaccaccuggaaaagcggauugaaaauuuaaacaaaaagaucgacgauggguuccuggacaucuggacuuacaaugccgagcuccuuguccuguuggaaaacgagcgcacccuagauuaucaugacucuaaugugaaaaaccuguacgagaagguacgaagccagcucaaaaacaaugcaaaggaaauuggcaacggauguuuugaguucuaucacaagugcgauaauacauguauggaaucaguuaaaaacggcacuuacgacuauccuaaguacagugaggaagccaaacugaauagagaggagaucgauggggugaaacuugaauccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 126818 - RNA, 1701 nt, Artificial Sequence
  derived and/or modified sequence opt3 from hemagglutinin__InfluenzaA__ADG21944
auggaggccauccugauugugcuccuuuacaccuucgcuacagcaaacgccgacacucugugcauaggcuaucacgcgaauaacagcacggauaccgucgacacaguuuuggaaaagaaugugacuguaacccauuccgugaacuuacuggaggauaaacacaaugggaagcuauguaaacucagaggagucgcuccccugcaucuugguaagugcaacaucgccggcuggauucuggggaauccugaaugugagucuuugucaacagcaaguagcugguccuacaucguggaaaccucuucgucagacaacggaacuugcuauccaggcgauuuuauugacuacgaggagcucagggaacagcugagcaguguuuccucuuucgagcgguuugaaaucuucccgaaaacaagcuccuggcccaaucacgauucaaacaagggugugaccgccgcuuguccucaugcaggggccaagaguuuuuauaaaaaucugauauggcucgucaagaaaggaaacagcuacccaaaguuaucuaaauccuauaucaaugacaagggcaaggaggugcugguacuuuggggcauucaccaccccucaacgagcgcugaucaacagaguuuguaccagaacgccgacgcguacguuuucguggggucuucccgcuauagcaaaaaguuuaaaccugagaucgcaauucgaccaaagguccgugaucaggaaggaagaaugaauuacuauuggacucugguggagcccggugacaaaaucaccuucgaagccacaggcaaccuaguggucccuagguacgcuuuugccauggagcggaacgcagggucgggaauaauuaucucugauacuccaguucaugacugcaauaccacaugucaaaccccgaagggcgcuauuaacacgucccuccccuuccacaauauccauccuaucacuauugguaaaugcccaaaguaugugaagucaacaaaacugcgccuugccaccgggcugagaaacguacccaguauacagagcaggggauuguuuggcgcgaucgccggcuucauugaagggggauggacugguaugguggacggcugguacggguaucaccaccagaaugagcagggauccggcuacgcagcugaucucaagucuacacaaaacgccaucgacgagauaaccaauaaagucaacagcgugauugaaaagaugaauacgcaguuuaccgcuguugguaaagaguucaaccaucuggaaaagcggaucgagaauuuaaacaagaaaguggaugacggguuccuggauaucuggacauacaaugccgaacuccuuguccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacaaugccggaucuguaucuga

SEQ ID NO: 126819 - RNA, 1701 nt, Artificial Sequence; identical to SEQ ID NO: 124927
  derived and/or modified sequence opt3 from hemagglutinin__InfluenzaA__ADG21945

SEQ ID NO: 126820 - RNA, 1701 nt, Artificial Sequence; identical to SEQ ID NO: 124927
  derived and/or modified sequence opt3 from hemagglutinin__InfluenzaA__ADG21946

SEQ ID NO: 126821 - RNA, 1701 nt, Artificial Sequence; identical to SEQ ID NO: 124927
  derived and/or modified sequence opt3 from hemagglutinin__InfluenzaA__ADG21947

SEQ ID NO: 126822 - RNA, 1701 nt, Artificial Sequence
  derived and/or modified sequence opt3 from hemagglutinin__InfluenzaA__ADG21948
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagaccaccaugauucaaauguaaagaaccuguaugaaaaaguucgaagucagcucaagaacaaugcaaaagagaucggcaacggauguuuugaguucuaccacaagugcgacaauaccuguauggaauccgugaagaacggcacauaugauuacccuaaauauagcgaagaggccaagcugaauagagaggaaauugacggggucaaacuugagucuacuaggaucuaccagauucuggcuauauauucaaccguggcgaguagcuugguccucgugguuucccugggagcaaucucuuuuuggaugugcucgaacgguagcuuacaaugccggauuuguaucuga

SEQ ID NO: 126823 - RNA, 1701 nt, Artificial Sequence
  derived and/or modified sequence opt3 from hemagglutinin__InfluenzaA__ADG27794
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggacauaucaaauccuggcuauuuacucuaccguggcgucaaguuugguccucgugguuagccugggagcaauauccuuuuggaugugcucuaacgguucguuacagugccggaucuguauuuga

SEQ ID NO: 126824 - RNA, 1701 nt, Artificial Sequence; identical to SEQ ID NO: 124672
  derived and/or modified sequence opt3 from hemagglutinin__InfluenzaA__ADG27948

SEQ ID NO: 126825 - RNA, 1701 nt, Artificial Sequence; identical to SEQ ID NO: 124672
  derived and/or modified sequence opt3 from hemagglutinin__InfluenzaA__ADG27966

SEQ ID NO: 126826 - RNA, 1701 nt, Artificial Sequence
  derived and/or modified sequence opt3 from hemagglutinin__InfluenzaA__ADG27974
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacggggucaaacuugaaucuacuaggaucuaucaaauucuggcuauauacucaaccguggcgaguagcuugauccucgucgugucccugggagcaauuucuuuuuggaugugcucgaacgguagcuuacagugccggaucuguaucuga

SEQ ID NO: 126827 - RNA, 1701 nt, Artificial Sequence
  derived and/or modified sequence opt3 from hemagglutinin__InfluenzaA__ADG27982
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguuaaaaagcuguacgagaaaguacgaagucagcucaagaacaacgcaaaggaaaucggcaauggauguuuugaguucuaucacaaaugcgacaacaccuguauggaauccgugaagaauggcacauacgauuauccuaaauacagcgaggaagccaagcugaacagagaggagauugacggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 126828 - RNA, 1701 nt, Artificial Sequence; identical to SEQ ID NO: 124672
  derived and/or modified sequence opt3 from hemagglutinin__InfluenzaA__ADG27988

SEQ ID NO: 126829 - RNA, 1701 nt, Artificial Sequence; identical to SEQ ID NO: 124672
  derived and/or modified sequence opt3 from hemagglutinin__InfluenzaA__ADG27997

SEQ ID NO: 126830 - RNA, 1701 nt, Artificial Sequence; identical to SEQ ID NO: 124672
  derived and/or modified sequence opt3 from hemagglutinin__InfluenzaA__ADG28011

SEQ ID NO: 126831 - RNA, 1701 nt, Artificial Sequence; identical to SEQ ID NO: 126237
  derived and/or modified sequence opt3 from hemagglutinin__InfluenzaA__ADG42093

SEQ ID NO: 126832 - RNA, 1701 nt, Artificial Sequence; identical to SEQ ID NO: 125849
  derived and/or modified sequence opt3 from hemagglutinin__InfluenzaA__ADG42103

SEQ ID NO: 126833 - RNA, 1701 nt, Artificial Sequence; identical to SEQ ID NO: 125038
  derived and/or modified sequence opt3 from hemagglutinin__InfluenzaA__ADG42113

SEQ ID NO: 126834 - RNA, 1701 nt, Artificial Sequence; identical to SEQ ID NO: 126237
  derived and/or modified sequence opt3 from hemagglutinin__InfluenzaA__ADG42123

SEQ ID NO: 126835 - RNA, 1701 nt, Artificial Sequence
  derived and/or modified sequence opt3 from hemagglutinin__InfluenzaA__ADG42133
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccuuaugcaggggccaaaaguuuuuacaagaaucugaucuggcucgugaaaaagggaaacagcuauccaaaauuaucuaaguccuacauaaaugacaagggcaaagaaguacugguucuuuggggcauccaucaccccucaacgagcgcugaucaacagaguuuguaccagaacgccgacgcguauguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugugacugggcugagaaacguccccucaauucagaguaggggauuguuuggcgccauagcgggcuucaucgaagggggauggacagguaugguggacggcugguauggguaccaccaucagaaugaacaaggaagcggcuacgccgcagaucucaaauccacccagcacgcuauugacgagaucacgaacaagguuaauucugugauagagaaaaugaacacccaguuuacagccgucgguaaggaguucaaucaccuggaaaagcggauugaaaacuuaaauaaaaagguggaugacggguuccuggauaucuggacuuauaacgcugagcuccuuguacuguuggaaaaugagcgcacccuagacuaccaugauagcaacguuaaaaaucuguaugagaaggugcgaucacagcucaaaaacaacgccaaggaaaucggcaauggauguuuugaguucuaccacaagugcgacaacacauguauggaaagugucaaaaauggcacuuaugauuacccuaaguauuccgaggaagcaaaacugaacagagaggagauugacggggugaaacuugaaagcaccaggaucuaccaaauucuggccauauacucuacagucgcuucaaguuuggugcucguugugagccugggagcgaucuccuuuuggaugugcucuaaugguucguuacagugccggauuuguaucuga

SEQ ID NO: 126836 - RNA, 1701 nt, Artificial Sequence
  derived and/or modified sequence opt3 from hemagglutinin__InfluenzaA__ADG42143
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaaaagaacgcagggucgggaauaauuaucucugauacuccagugcaugacugcaauaccacaugucaaaccccgaaaggcgcuauuaacacgucccuacccuuccagaauauccacccuaucacuauugguaagugcccaaaauauguaaagucaacaaaacuccggcuggccaccgggcuucgcaacgugcccaguauacagagcagaggacuguuuggcgcgaucgccggcuucauugaagggggauggacugguauggucgacggcugguacggguaucaucaccagaaugaacaaggauccggcuacgcagcugauuugaagucuacacagaacgccaucgacgagauaaccaauaaagugaacagcguuauugagaagaugaauacgcaguuuaccgcuguggguaaggaguucaaccaccucgagaaaaggaucgaaaaucugaacaagaaagucgaugacggguucuuagauaucuggacauacaaugccgagcugcucgugcuucuggaaaacgagcggacuuuggacuaucaugauucaaauguaaagaaccuauacgagaaaguucgcagucagcugaagaacaaugcaaaggaagugggcaacggauguuuugaguucuaucacaaaugcgacaauaccuguauggaauccgucaagaacggcacauacgauuauccuaaauacagcgaggaagccaagcucaaucgagaggagauugacggggugaaacuggaaucuacuagaaucuaucaaauucuugcuauauacucaaccgcggcaaguagccuggucuuggugguuucccucggagccaucucuuuuuggaugugcucgaacgguagccugcagugcaggauuuguaucuga

SEQ ID NO: 126837 - RNA, 1701 nt, Artificial Sequence
  derived and/or modified sequence opt3 from hemagglutinin__InfluenzaA__ADG42153
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucucgacugcaauacaaccugucaaacgccgaaaggcgcuauuaacacuucucugcccuuccagaauauccauccuaucacaauugguaagugcccaaaguaugugaaauccaccaaacuucgccuggccacuggguugagaaacguacccucaauacagaguaggggacucuuuggcgcgaucgccggcuucauugaagggggauggacagguaugguggacggcugguacggguaucaccaucagaaugaacaaggaagcggcuacgcagcugaucugaaguccacccagaacgccaucgacgagauaacgaauaaggucaacucugugauugagaaaaugaauacccaguuuacagcuguugguaaggaguucaaccacuuagaaaagcggaucgaaaaucugaacaaaaagguggaugacggguuccucgauaucuggacuuacaaugccgagcuucuggucuugcuagaaaacgagcgcacccuggacuaucacgauagcaaugugaaaaaccucuacgagaagguacgaucacagcugaaaaacaaugcaaaggaaauuggcaacggauguuuugaguucuaucauaagugcgacaauacauguauggaaaguguuaaaaacggcacuuacgauuauccuaaguacuccgaggaagccaaacuuaauagagaggagaucgacggggugaagcuggaaagcaccaggauuuaucaaauauuggcuaucuacucuacagucgcgucaagucucgugcuggucgugagcuuaggagcaauuuccuuuuggaugugcucuaacgguucgcugcagugccggaucuguaucuga

SEQ ID NO: 126838 - RNA, 1701 nt, Artificial Sequence; identical to SEQ ID NO: 124685
  derived and/or modified sequence opt3 from hemagglutinin__InfluenzaA__ADG42193

SEQ ID NO: 126839 - RNA, 1701 nt, Artificial Sequence; identical to SEQ ID NO: 124685
  derived and/or modified sequence opt3 from hemagglutinin__InfluenzaA__ADG42213

SEQ ID NO: 126840 - RNA, 1701 nt, Artificial Sequence; identical to SEQ ID NO: 124685
  derived and/or modified sequence opt3 from hemagglutinin__InfluenzaA__ADG42233

SEQ ID NO: 126841 - RNA, 1701 nt, Artificial Sequence
  derived and/or modified sequence opt3 from hemagglutinin__InfluenzaA__ADG42243
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcucgacugcaauacaaccugucaaacgccgaaaggcgcuaucaacacuucucugcccuuccagaauauucauccuaucacaaucgguaagugcccaaaguauguaaaauccaccaaacuucgccuggccacuggguugagaaacgugcccucaauucagaguaggggacucuuuggcgcgauagccggcuucaucgaagggggauggacagguauggucgacggcugguacggguaucaccaucagaaugaacaaggaagcggcuacgcagcugaucugaaguccacccagcacgccauugacgagaucacgaacaagguaaauucuguuauagagaaaaugaacacccaguuuacagcuguggguaaggaguucaaucacuuagaaaagcggauugaaaaccugaauaaaaaggucgaugacggguuccucgauaucuggacuuacaacgccgagcuucugguguugcuagaaaaugagcgcacccuggacuaucaugauagcaacgugaaaaaucucuacgagaagguucgaucacagcugaaaaacaacgcaaaggaaaucggcaauggauguuuugaguucuaucacaagugcgacaacacauguauggaaagugugaaaaauggcacuuacgauuauccuaaguacuccgaggaagccaaacuuaacagagaggagauugacggggucaagcuggaaagcaccaggaucuaucaaauuuuggcuauauacucuacaguggcgucaagucucguccuggugguuagcuuaggagcaaucuccuuuuggaugugcucuaaugguucgcugcagugccggauuuguaucuga

SEQ ID NO: 126842 - RNA, 1701 nt, Artificial Sequence; identical to SEQ ID NO: 126105
  derived and/or modified sequence opt3 from hemagglutinin__InfluenzaA__ADG42253

SEQ ID NO: 126843 - RNA, 1701 nt, Artificial Sequence; identical to SEQ ID NO: 124685
  derived and/or modified sequence opt3 from hemagglutinin__InfluenzaA__ADG42263

SEQ ID NO: 126844 - RNA, 1701 nt, Artificial Sequence; identical to SEQ ID NO: 125786
  derived and/or modified sequence opt3 from hemagglutinin__InfluenzaA__ADG42273

SEQ ID NO: 126845 - RNA, 1701 nt, Artificial Sequence; identical to SEQ ID NO: 125786
  derived and/or modified sequence opt3 from hemagglutinin__InfluenzaA__ADG42283

SEQ ID NO: 126846 - RNA, 1701 nt, Artificial Sequence; identical to SEQ ID NO: 126368
  derived and/or modified sequence opt3 from hemagglutinin__InfluenzaA__ADG42293

SEQ ID NO: 126847 - RNA, 1701 nt, Artificial Sequence
  derived and/or modified sequence opt3 from hemagglutinin__InfluenzaA__ADG42303
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagagagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucgugauaucggauaccccaguacaugacugcaauacaaccugucaaacgccgaagggcgcuauuaacacuucucuccccuuccagaauauccacccuauuacaaucgguaagugcccaaaauaugugaaguccaccaaacugcggcuugccacugggcugcgcaacguccccucaauccagaguagaggauuguuuggcgcgauugccggcuucauagaagggggauggacagguaugguggacggcugguacggguaucaucaccagaaugaacaaggaagcggcuacgcagcugaucucaaguccacccagaacgccaucgacgagauuacgaauaaaguuaacucugugaucgagaagaugaauacccaguuuacagcugucgguaaggaauuuaaccaccuggagaaaaggauagaaaauuuaaacaagaaaguggaugacggguuccuggauauuuggacuuacaaugccgagcuccuuguacuguuggaaaacgagcggacccuagacuaucaugauagcaauguuaagaaccuguacgagaaagugcgcucacagcucaagaacaaugcaaaggaaaucggcaacggauguuucgaguucuaucacaaaugcgacaauacauguauggaaagugucaagaacggcacuuacgauuauccuaaauacuccgaggaagccaagcugaaucgagaggagaucgacggggugaaacuugaaagcaccagaauuuaucaaauccuggcuauuuacucuacagucgcgucaaguuuggugcucguugugagccugggagcaauauccuuuuggaugugcucuaacgguucguuacagugcaggaucuguauuuga

SEQ ID NO: 126848 - RNA, 1701 nt, Artificial Sequence; identical to SEQ ID NO: 126395
  derived and/or modified sequence opt3 from hemagglutinin__InfluenzaA__ADG42313

SEQ ID NO: 126849 - RNA, 1701 nt, Artificial Sequence
  derived and/or modified sequence opt3 from hemagglutinin__InfluenzaA__ADG42323
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacgagauuacgaauaaggugaacucuguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauagcaauguaaagaaccuguacgagaagguucgaucacagcucaaaaacaaugcaaaggaagugggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggaucuaucaaauucuggcuaucuacucuacagucgcgucaaguuuggugcucguugugagccugggagcaauuuccuuuuggaugugcucuaacgguucguuacagugccggauauguaucuga

SEQ ID NO: 126850 - RNA, 1701 nt, Artificial Sequence
  derived and/or modified sequence opt3 from hemagglutinin__InfluenzaA__ADG42333
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaauagcuccccuucaucuggguaaaugcaacaucgccggcuggauuuuggggaauccugagugugaaucucucucaacagcaaguagcugguccuacaucguggagaccucuucgucagacaacggaacuugcuauccaggcgauuucauugacuacgaggagcugagggagcagcugagcaguguuuccucuuuugaacgguucgagaucuuuccgaagacaagcuccuggcccaaucacgauucaaacaagggugugaccgccgcuuguccucaugcaggggccaaaaguuucuauaagaaucucauaugguuagucaaaaagggaaacagcuacccaaaacugucuaaguccuauaucaaugacaagggcaaagaagugcuuguauuguggggcauucaccaccccucaacgagcgcugaucaacagagucuguaccagaacgccgacgcguacguuuuuguggggacuucucgcuauuccaagaaauucaagccugagaucgcaauucgaccaaaaguccgugaucaggagggaagaaugaauuacuauuggacccuaguggaacccggugacaagaucacauuugaggccacuggcaaccucguggucccuagguacgcuuucgccauggaacggaacgcagggagcggaauaauuaucucggaugcuccaguucaugacugcaauaccacaugucaaaccccgaaaggcgccauuaacacgucucugcccuuucagaauauccacccuaucacuauugguaagugcccaaaguaugugaaauccacaaaacuucgccuggcgaccggguugagaaacguacccucaauacagaguaggggacucuucggcgccaucgcaggcuuuauugaagggggauggacugguaugguggacggcugguacggguaucaucaccagaaugaacaaggaagcggcuacgcugccgaucugaaguccacacagaacgcuaucgacgagauaaccaauaaggucaacucugugauugagaaaaugaauacgcaguucaccgccguugguaaggaauuuaaccacuuagagaagcggaucgaaaaucugaacaaaaagguggaugacggguuccucgauaucuggacauacaaugcagagcuucuggucuugcuagaaaacgagcgcacucuggacuaucaugauagcaaugugaaaaaccucuacgagaagguacgaucacagcugaaaaacaaugccaaggaaauuggcaacggauguuucgaguuuuaucacaagugcgacaauaccuguauggaaaguguuaaaaacggcacauacgauuauccuaaguacuccgaggaagcuaaacuuaauagagaggagaucgacggggugaagcuggaaagcacuaggauuuaucaaauauuggcgaucuacucuaccgucgcaucaagucucgugcuggucgugagcuuaggagccauuuccuucuggaugugcucuaacgguucgcugcagugccggaucuguaucuga

SEQ ID NO: 126851 - RNA, 1701 nt, Artificial Sequence
  derived and/or modified sequence opt3 from hemagglutinin__InfluenzaA__ADG42343
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaaagcaacgcagggucgggaaucauaauuucugauaccccagugcaugacugcaauacaaccugucaaacgccgaaaggcgcuaucaacacuucccuccccuuccagaauauucacccuaucacaaucgguaagugcccaaaguauguaaaaucaaccaagcugcggcuugccacugggcugcgcaacgugcccaguauucagagcagaggauuguuuggcgcgauagccggcuucaucgaagggggauggacagguauggucgacggcugguacggguaucaucaccagaaugaacaaggauccggcuacgcagcugaucucaaaucuacccagcacgccauugacgagaucacgaacaaggugaauagcguuauagagaaaaugaacacccaguuuacagcuguggguaaggaguucaaucaucuggaaaagaggauugaaaacuuaaauaaaaaggucgaugacggguuccuggauaucuggacuuacaacgccgagcuccuugugcuguuggaaaaugagcggacccuagacuaucacgauucaaacguaaagaaucuguacgagaagguucgcagucagcucaaaaacaacgcaaaggaaaucggcaauggauguuuugaguucuaucauaagugcgacaacacauguauggaauccgugaaaaauggcacuuacgauuauccuaaguacagcgaggaagccaaacugaaccgagaggagauugacggggucaaacuugaaucuaccagaaucuaucaaauucuggcuauauacucaacaguggcgaguagcuugguccucgugguuucccugggagcaaucucuuuuuggaugugcucgaaugguagcuuacagugcaggauuuguaucuga

SEQ ID NO: 126852 - RNA, 1701 nt, Artificial Sequence
  derived and/or modified sequence opt3 from hemagglutinin__InfluenzaA__ADG42363
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 126853 - RNA, 1701 nt, Artificial Sequence
  derived and/or modified sequence opt3 from hemagglutinin__InfluenzaA__ADG42373
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaaaccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126854 - RNA, 1701 nt, Artificial Sequence
  derived and/or modified sequence opt3 from hemagglutinin__InfluenzaA__ADG42393
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaacaggaggggagaaugaauuacuauuggacccugguggaacccggagauaagauuacauucgaggccacugguaaccuagucguuccuagguacgcuuuugccauggaacggaacgcaggcagcgggaucauaauuucggacaccccagugcaugauugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgagggcggguggacaggaauggucgacgguugguacggcuaucaucaccagaaugagcaagggagcggauacgcagcugaccucaaauccacccagaacgccauugaugaaaucacgaauaaggugaacucuguuauagagaaaaugaauacccaguuuacagcugugggcaaggaguucaaccaccuggaaaagcggauugaaaauuuaaacaaaaaggucgacgaugguuuccuggacaucuggacuuacaaugccgagcuccuugugcuguuggagaacgaacgcacccuagauuaucaugacagcaauguaaagaaccuguacgagaagguucgaucacagcucaaaaacaaugcaaaggaaaucgggaacggcuguuuugaguucuaucacaagugcgauaauacauguauggaaagugugaaaaacggaacuuacgacuauccuaaguacuccgaggaggccaaacugaauagagaagagauugauggcgucaaacuugaaagcaccaggaucuaucaaauucuggcuauauacucuacaguggcgucaaguuugguccuccuggugagcuuaggggcaaucuccuuuuggaugugcucuaacggaucgcugcagugccggauuuguaucuga

SEQ ID NO: 126855 - RNA, 1701 nt, Artificial Sequence; identical to SEQ ID NO: 125849
  derived and/or modified sequence opt3 from hemagglutinin__InfluenzaA__ADG42403

SEQ ID NO: 126856 - RNA, 1701 nt, Artificial Sequence; identical to SEQ ID NO: 126105
  derived and/or modified sequence opt3 from hemagglutinin__InfluenzaA__ADG42413

SEQ ID NO: 126857 - RNA, 1701 nt, Artificial Sequence; identical to SEQ ID NO: 126852
  derived and/or modified sequence opt3 from hemagglutinin__InfluenzaA__ADG42423

SEQ ID NO: 126858 - RNA, 1701 nt, Artificial Sequence; identical to SEQ ID NO: 126105
  derived and/or modified sequence opt3 from hemagglutinin__InfluenzaA__ADG42443

SEQ ID NO: 126859 - RNA, 1701 nt, Artificial Sequence
  derived and/or modified sequence opt3 from hemagglutinin__InfluenzaA__ADG42453
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcgggucgaaaaucugaacaaaaagguggaugacggguucuuagauaucuggacuuacaaugccgagcugcucguacuucuggaaaacgagcgcaccuuggacuaucaugauagcaauguuaaaaaccuauacgagaaggugcgaucacagcugaaaaacaaugcaaaggaaaucggcaacggauguuuugaguucuaucacaagugcgacaauacauguauggaaagugucaaaaacggcacuuacgauuauccuaaguacuccgaggaagccaaacucaauagagaggagauugacggggugaagcuggaaagcaccaggaucuaucaaauucuugcuauauacucuacagucgcgucaagucugguguugguugugagccucggagcaaucuccuuuuggaugugcucuaacgguucgcugcagugccggauuuguaucuga

SEQ ID NO: 126860 - RNA, 1701 nt, Artificial Sequence; identical to SEQ ID NO: 125038
  derived and/or modified sequence opt3 from hemagglutinin__InfluenzaA__ADG42463

SEQ ID NO: 126861 - RNA, 1701 nt, Artificial Sequence; identical to SEQ ID NO: 124685
  derived and/or modified sequence opt3 from hemagglutinin__InfluenzaA__ADG42473

SEQ ID NO: 126862 - RNA, 1701 nt, Artificial Sequence; identical to SEQ ID NO: 126105
  derived and/or modified sequence opt3 from hemagglutinin__InfluenzaA__ADG42483

SEQ ID NO: 126863 - RNA, 1701 nt, Artificial Sequence; identical to SEQ ID NO: 126237
  derived and/or modified sequence opt3 from hemagglutinin__InfluenzaA__ADG42493

SEQ ID NO: 126864 - RNA, 1701 nt, Artificial Sequence; identical to SEQ ID NO: 126298
  derived and/or modified sequence opt3 from hemagglutinin__InfluenzaA__ADG42503

SEQ ID NO: 126865 - RNA, 1701 nt, Artificial Sequence; identical to SEQ ID NO: 125786
  derived and/or modified sequence opt3 from hemagglutinin__InfluenzaA__ADG42513

SEQ ID NO: 126866 - RNA, 1701 nt, Artificial Sequence
  derived and/or modified sequence opt3 from hemagglutinin__InfluenzaA__ADG42533
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaagacaagcuccuggcccaaccacgauucaaauaaaggugucaccgccgcuuguccucaugcaggggccaagaguuuuuauaaaaaccugaucuggcucgugaagaaaggaaauagcuacccaaaguuaucuaaguccuauauaaacgacaaaggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaucuagucguuccuagguacgcuuuugccauggaacggaacgcagggagcggaaucauaauuucggauaccccagugcaugacugcaacacaaccugucaaacgccgaagggcgcuaucaauacuucucuccccuuccagaacauucacccuaucacaaucgguaagugcccaaaauauguaaaguccaccaaacugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaucucaaguccacccagaaugccaucgacgagauaacgaacaaagucaauucugugauugagaagaugaacacccaguuuacagcuguugguaaggaguucaaucaccuggaaaaacggaucgaaaacuuaaauaagaaaguggaugacggguuccuggauaucuggacuuacaacgccgagcuccuuguccuguuggaaaaugagcgcacccuagacuaucaugauagcaacgugaagaaucuguacgagaaaguacgaucacagcucaagaacaacgcaaaggaaauuggcaauggauguuuugaguucuaucacaaaugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126867 - RNA, 1701 nt, Artificial Sequence
  derived and/or modified sequence opt3 from hemagglutinin__InfluenzaA__ADG42553
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuaaauaaguccuauauaaacgacaagggcaaagaaguacugguucuuuggggcauccaccacccaucaacgagcgcugaucaacagaguuuguaccagaaugccgacgcguacguguucgucgggacuucucgcuauuccaagaaauuuaagcccgagauugcaauccgaccuaaagugcgugagcaggaaggaagaaugaacuacuauuggacccugguggagccaggugauaagauuacauucgaagccacuggcaaccuagucguucccagguacgcuuuugccauggagcggaaugcagggagcggaaucauaauuucggacaccccugugcaugauugcaacacaaccugucaaacgccaaaaggcgcuaucaauacuucucucccguuccagaacauucaccccaucacaaucgguaagugcccuaaguauguaaaauccaccaagcugcgccuugccacugggcugagaaaugugccaucaauucagaguaggggauuguuuggcgcgauagccggcuucaucgaagggggauggacagguauggucgacggcugguacggguaucaucaccagaacgagcaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugagaacuuaaauaaaaaggucgacgauggguuccuggacaucuggacuuacaacgccgaacuccuugugcuguuggagaaugagcgcacccuagauuaucaugacagcaacgugaaaaaccuguacgaaaagguucgaucacagcucaaaaauaacgcaaaggagaucggcaauggauguuuugaguucuaucacaagugcgauaacacauguauggaaagugugaaaaauggcacuuacgacuaucccaaguacuccgaagaggccaaacugaacagagaggaaauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126868 - RNA, 1701 nt, Artificial Sequence
  derived and/or modified sequence opt3 from hemagglutinin__InfluenzaA__ADG42573
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugauugaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaagcuguacgagaaaguacgaucacagcucaagaacaacgcaaaggaaauuggcaauggauguuuugaguucuaucacaaaugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126869 - RNA, 1701 nt, Artificial Sequence
  derived and/or modified sequence opt3 from hemagglutinin__InfluenzaA__ADG42583
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagcacgcuauugacgagaucacgaacaaggugaauagcguuauagagaaaaugaacacccaguuuacagccguggguaaggaguucaaucaucuggaaaagcggauugaaaacuuaaauaaaaaggucgaugacggguuccuggauaucuggacuuacaacgcugagcuccuugugcuguuggaaaaugagcgcacccuagacuaucacgauucaaacguaaagaaucuguacgagaagguucgaagucagcucaaaaacaacgccaaggaaaucggcaauggauguuuugaguucuaucauaagugcgacaacacauguauggaauccgugaaaaauggcacuuacgauuauccuaaguacagcgaggaagcaaaacugaacagagaggagauugacggggucaaacuugaaucuaccaggaucuaucaaauucuggccauauacucaacaguggcuaguagcuugguccucgugguuucccugggagcgaucucuuuuuggaugugcucgaaugguagcuuacagugccggauuuguaucuga

SEQ ID NO: 126870 - RNA, 1701 nt, Artificial Sequence; identical to SEQ ID NO: 126282
  derived and/or modified sequence opt3 from hemagglutinin__InfluenzaA__ADG42593

SEQ ID NO: 126871 - RNA, 1701 nt, Artificial Sequence
  derived and/or modified sequence opt3 from hemagglutinin__InfluenzaA__ADG42603
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuacgcaagucuuauauaaaugacaagggcaaagaaguacugguucuuuggggcauccaccaccccuccacgucagcugaucaacagagcuuguaccagaacgccgacgcguacguguucgucgggacuucucgauauucuaagaaauuuaagccugagauugcaacccguccaaaagugagagaucaggagggaaggaugaauuacuauuggacacugguggaacccggugacaagaucacuuucgaggccaccggcaaccuagucguuccucgguacgcuuuugccauggaacgcaacgcaggguccggaauuaucauaagcgauacaccagugcaugacugcaauaccacgugucaaacuccgaaaggcucgauuaacacaucucuccccuuccagaauauccacccuauuaccaucgguaagugcccaaaguauguaaaauccacuaagcugagacuugcuacagggcugaggaacgugcccucaauccagagucggggauuguuuggcgccauugcgggcuucauagaagggggauggaccgguauggucgacggcugguacggguaucaucaccagaaugaacaaggaagcggcuacgccgcagaucucaaauccacgcagcacgcuaucgacgagauuaccaacaaggugaauaguguuaucgagaaaaugaacacacaguuuacugccguggguaaggaguucaaucaucuggaaaagcgcauagaaaacuuaaauaaaaaggucgaugacggguuccuggauauuuggaccuacaacgcugagcuccuugugcuguuggaaaaugagcgaacacuagacuaucacgauagcaacguaaagaaucuguacgagaagguuagaucacagcucaaaaacaacgccaaggaaaucggcaauggauguuuugaguucuaucauaagugcgacaacacuuguauggaaagugugaaaaauggcaccuacgauuauccuaaguacuccgaggaagcaaaacugaacagggaggagaucgacggggucaaacuugaaagcacacggauuuaucaaauccuggccauuuacucuaccguggcuucaaguuugguccucgugguuagccugggagcgauauccuuuuggaugugcucuaaugguucguuacagugccguaucuguauuuga

SEQ ID NO: 126872 - RNA, 1701 nt, Artificial Sequence
  derived and/or modified sequence opt3 from hemagglutinin__InfluenzaA__ADG42613
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagagaagaucgacggggucaaacuggagagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 126873 - RNA, 1701 nt, Artificial Sequence; identical to SEQ ID NO: 126312
  derived and/or modified sequence opt3 from hemagglutinin__InfluenzaA__ADG42623

SEQ ID NO: 126874 - RNA, 1701 nt, Artificial Sequence; identical to SEQ ID NO: 124685
  derived and/or modified sequence opt3 from hemagglutinin__InfluenzaA__ADG42633

SEQ ID NO: 126875 - RNA, 1701 nt, Artificial Sequence
  derived and/or modified sequence opt3 from hemagglutinin__InfluenzaA__ADG42643
augaaggccauccuggugguccuccuuuacaccuucgcuacagcaaacgccgacacucugugcauuggcuaucacgcgaauaacagcacggauaccguugacacaguguuggagaagaauguaacugugacccauuccgcuaacuuacuggaagauaagcacaaugggaaacuauguaagcucagaggagccgcaccccugcaucuugguaaaugcaacauagccggcuggauccuggggaauccugagugugaaucuuugucaacagcuaguagcugguccuacauugucgagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaaggguguuaccgcagccuguccucaugcuggggccaaaaguuuuuauaagaaucugauuuggcucgugaaaaagggaaacagcuacccaaaauuaucuaaguccuaugucaaugacaagggcaaagaagugcugguacuuuggggcauccaccaccccucaacgagcgcggaucaacagaguuuguaccagaacgcagacgccuacguuuucguggggacuucucgcuauuccaagaaauuuaagccugagauagcuauccgaccaaaaguccgugaucaggagggaagaaugaauuacuauuggacccugguggaacccggugacaagauuacauucgaggccacuggcaaccuaguggucccuagguacgcauuugcuauggaacggaacgccgggagcggaaucauuaucucggauaccccaguucaugacugcaauacaaccugucaaacgccgaaaggcgcgauaaacacuucucuccccuuccagaauauucacccuaucacaauugguaagugcccaaaguaugugaaauccaccaagcugcgccuugccacugggcugagaaacguacccucaauccagaguaggggauuguuuggcgcaaucgcuggcuucauugaagggggauggacagguaugguggacggcugguacggguaucaucaccagaaugaacaaggaagcggcuacgccgcugaucucaaauccacccagaacgccauagacgagaucacgaauaaggucaacucugugauugagaaaaugaauacccaguuuacagcaguugguaaggaguucaaccaccuggaaaagcggaucgaaaauuuaaacaaaaagguggaugacggguuccuggauauauggacuuacaaugccgagcuccuuguccuguuggaaaacgagcgcacccuagacuaucaugauagcaaugugaaaaaccuguacgagaagguacgaucacagcucaaaaacaaugcuaaggaaauuggcaacggauguuuugaguucuaucacaagugcgacaauacauguauggaaaguguuaaaaacggcacuuacgauuauccuaaguacuccgaggaagcgaaacugaauagagaggagaucgacggggugaaacuugaaagcaccaggaucuaucaaauucuggcaaucuacucuacagucgccucaaguuuggugcucgucgugagccugggagcuauuuccuuuuggaugugcucuaacgguucguuacagugccggauauguaucuga

SEQ ID NO: 126876 - RNA, 1701 nt, Artificial Sequence
  derived and/or modified sequence opt3 from hemagglutinin__InfluenzaA__ADG42653
augaaggccauccuggugguccuccuuuacaccagcgcuacagcaaacgccgacacucugugcauuggcuaucacgcgaauaacuccacggauaccguugacacaguguuggagaaaaauguaacugugacccauucugucaacuuacuggaagauaagcacaaugggaaacuauguaagcucagaggaguggcuccccugcaucuugguaaaugcaacauagccggcuggauccuggggaauccugagugugaaucauugaguacagcaagcuccuggucuuacauuguugagaccucgucaagcgacaacggaacuugcuauccaggcgauuucaucgacuacgaggagcucagggagcagcugaguuccgugucuagcuuugaacgguucgagauguuuccgaagacauccucauggcccaaucacgauaguaacaagggugucaccgccgcuuguccucaugcaggggccaagagcuucuauaagaaucugauuuggcucgugaaaaagggaaacucuuacccaaaauuauccaagucauauaucaaugacaagggcaaagaaguacugguucuuuggggcauacaccaccccagcacgagugcugaucaacagucuuuguaccagaacgccgacgcguacguguuugucgggacuucccgcuauagcaagaaauucaagccugagaucgcaauucgaccaaaagugcgugaucaggagggaagaaugaauuacuauuggacccugguggaacccggugacaagaucacauuugaggccacuggcaaccuagucguuccuagguacgcuuucgccauggaacggaacgcagggucgggaauuaucauaucugauaccccagugcaugacugcaauacaaccugucaaacgccgaaaggcgcuauuaacacuucccuccccuuucagaauauccacccuauuacaaucgguaagugcccaaaguauguaaaaucaaccaagcugcgccuugccacugggcugagaaacgugcccaguauccagagcaggggauuguucggcgcgauugccggcuuuauagaagggggauggacagguauggucgacggcugguacggguaucaucaccagaaugaacaaggauccggcuacgcagcugaucucaaaucuacccagaacgccaucgacgagauuacgaauaaggugaacagcguuaucgagaaaaugaauacccaguucacagcuguggguaaggaauuuaaccaccuggagaagcggauagaaaauuuaaacaaaaaggucgaugacggguuccuggauauuuggacuuacaaugccgagcuccuugugcuguuggaaaacgagcgcacccuagacuaucaugauucaaauguuaaaaaccuguacgagaagguacgaagucagcucaaaaacaaugcaaaggaaaucggcaacggauguuucgaguuuuaucacaagugcgacaauacauguauggaauccgugaaaaacggcacuuacgauuauccuaaguacagcgaggaagccaaacugaauagagaggagaucgacggggucaaacuugaaucuaccaggauuuaucaaauccuggcuauuuacucaacaguggcgaguagcuugguccucgugguuucccugggagcaauaucuuucuggaugugcucgaacgguagcuuacagugccggaucuguauuuga

SEQ ID NO: 126877 - RNA, 1701 nt, Artificial Sequence; identical to SEQ ID NO: 125849
  derived and/or modified sequence opt3 from hemagglutinin__InfluenzaA__ADG42663

SEQ ID NO: 126878 - RNA, 1701 nt, Artificial Sequence
  derived and/or modified sequence opt3 from hemagglutinin__InfluenzaA__ADG42673
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaggaaguuggagcuacauuguugagaccuccucuucggacaacggcacuugcuauccaggugauuuuaucgacuacgaagaacucagagagcagcugucaagcgugaguuccuucgaaagguuugagauuuucccgaagacaucuagcuggcccaaucacgauuccaacaaaggggucaccgccgcuuguccucaugcaggagccaagucauuuuauaaaaaucugaucuggcucgugaagaaaggcaacaguuacccaaaguuaagcaagucuuauauaaaugacaaaggcaaggaaguacugguucuuugggggauccaccaccccuccacgucagcugaucaacagagcuuguaccagaacgccgacgcguacguguucgucggaaccagucgguauucuaaaaaguuuaaaccugagauugcaauccgcccaaaggugcgagaucaggagggucguaugaauuacuauuggacucugguggaacccggcgacaaaauuacauucgaggccacugggaaccuagucguuccuagauacgcuuuugccauggaaaggaacgcaggauccggcaucauaauuagcgauaccccagugcaugacugcaauacaaccugucaaacgccgaagggugcuaucaacacuucgcuccccuuccagaauauucacccuaucacaaucgggaagugcccaaaauauguaaagucuaccaaacugcggcuugccacuggacugcgcaacgugcccuccauucagucaagaggcuuguuuggcgcgauagccggguucaucgagggagguuggacaggcauggucgacgggugguacggauaucaucaccagaaugaacaaggcagugguuacgcagcugaucucaagagcacccagaacgccauugacgggaucacgaauaaagugaacuccguuauagagaagaugaauacccaguuuacagcugugggcaaggaguucaaccaccuggagaaaaggauugagaauuuaaacaagaaagucgaugacggauuccuggauaucuggacuuacaaugccgaacuccuugugcuguuggagaacgaacggacccuagacuaucaugauucuaauguaaagaaccuguacgagaaaguucgcagccagcucaagaacaaugcaaaggagaucggcaacggguguuuugaguucuaucacaaaugcgacaauacauguauggaaucagugaagaacggaacuuacgauuauccuaaauacagugaagaggccaagcugaaucgagaagagauugacggugucaaacuugaguccaccagaaucuaucaaauucuggcuauauacagcacaguggcgucuucauugguccucgugguuagucugggcgcaaucagcuuuuggaugugcuccaacgggucuuuacagugcaggauuuguaucuga

SEQ ID NO: 126879 - RNA, 1701 nt, Artificial Sequence
  derived and/or modified sequence opt3 from hemagglutinin__InfluenzaA__ADG42683
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcaauuuuauugauuacgaagaguugagggagcagcucagcaguguguccucuuucgaacgguuugagaucuucccgaagacaagcuccuggcccaaccacgacucaaauaagggugucaccgccgcuuguccucaugcaggggccaaaaguuuuuauaagaaccugauauggcuggugaaaaagggaaauagcuacccaaaacucucuaaguccuauaucaacgauaagggcaaagaaguauuaguucuguggggcauucaccaccccucaacgagcgcugaccaacagagucuuuaccagaaugccgaugcguacguguucgucgggacuucucgcuauuccaagaaauuuaagccugagaucgcaauucgaccaaaagugcgugaccaggagggaagaaugaacuacuauuggaccuugguggaacccggugauaagaucacauucgaggccacuggcaaccuggucguuccuagguacgcuuuugccauggaacggaaugcagggagcggaauaauuaucucggacaccccagugcaugauugcaacacaaccugucaaacgccgaaaggcgcuauuaauacuucucuacccuuccagaacauccacccuaucacaauugguaagugcccaaaguauguaaaauccaccaagcuccgccuggccacugggcuuagaaaugugcccucaauacagaguaggggacuguuuggcgcgaucgccggcuucauugaagggggauggacagguauggucgacggcugguacggguaucaucaccagaacgaacaaggaagcggcuacgcagcugacuugaaauccacccagaaugccaucgaugagauaacgaacaagguaaauucuguuauugagaaaaugaacacccaguuuacagcuguggguaaggaguucaaucaccucgagaagcggaucgaaaaccugaauaaaaaggucgacgauggguucuuagacaucuggacuuacaacgccgagcugcucgugcuucuggaaaaugagcgcaccuuggauuaucaugacagcaacgugaaaaaccuauacgagaagguucgaucacagcugaaaaauaacgcaaaggaaauuggcaauggauguuuugaguucuaucacaagugcgauaacacauguauggaaagugugaaaaauggcacuuacgacuauccuaaguacuccgaggaagccaaacucaacagagaggagaucgauggggucaagcuggaaagcaccaggauuuaucaaauacuugcuaucuacucuacaguggcgucaagucuggucuuggugguuagccucggagcaauuuccuuuuggaugugcucuaaugguucgcugcagugccggaucuguaucuga

SEQ ID NO: 126880 - RNA, 1701 nt, Artificial Sequence; identical to SEQ ID NO: 125849
  derived and/or modified sequence opt3 from hemagglutinin__InfluenzaA__ADG42693

SEQ ID NO: 126881 - RNA, 1701 nt, Artificial Sequence; identical to SEQ ID NO: 126557
  derived and/or modified sequence opt3 from hemagglutinin__InfluenzaA__ADG42703

SEQ ID NO: 126882 - RNA, 1701 nt, Artificial Sequence
  derived and/or modified sequence opt3 from hemagglutinin__InfluenzaA__ADG42723
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauggcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacaagauuacgaauaaagugaacucuguuaucgagaagaugaauacccaguuuacagcuguggguaaggaguucaaccaccuggaaaaacggauagagaauuuaaacaagaaagucgaugacggguuccuggauauuuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagaucgacggggucaaacuugagagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 126883 - RNA, 1701 nt, Artificial Sequence; identical to SEQ ID NO: 126312
  derived and/or modified sequence opt3 from hemagglutinin__InfluenzaA__ADG42743

SEQ ID NO: 126884 - RNA, 1701 nt, Artificial Sequence
  derived and/or modified sequence opt3 from hemagglutinin__InfluenzaA__ADG42753
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacagcgggucgggaaucauaauuucugauacaccagugcaugacugcaauaccacgugucaaacuccgaaaggcgccaucaacacaucccuccccuuccagaauauucacccuaucaccaucgguaagugcccaaaguauguaaaaucaacuaagcugcgccuugcaacagggcugagaaacgugcccaguauucagagcaggggauuguuuggcgcuauagccggcuucaucgaagggggauggaccgguauggucgacggcugguacggguaucaucaccagaaugaacaaggauccggcuacgcggccgaucucaaaucuacgcagaacgcaauugacgagaucaccaauaaggugaacagcguuauagagaaaaugaauacacaguuuacugcuguggguaaggaguucaaccaccuggaaaagcggauugaaaauuuaaacaaaaaggucgaugacggguuccuggauaucuggaccuacaaugccgagcuccuugugcuguuggaaaacgagcgcacacuagacuaucaugauucaaauguaaagaaccuguacgagaagguucgaagucagcucaaaaacaaugcuaaggaaaucggcaacggauguuuugaguucuaucacaagugcgacaauacuuguauggaauccgugaaaaacggcaccuacgauuauccuaaguacagcgaggaagccaaacugaauagagaggagauugacggggucaaacuugaaucuacaaggaucuaucaaauucuggcaauauacucaaccguggccaguagcuugguccucgugguuucccugggagcuaucucuuuuuggaugugcucgaacgguagcuuacagugccggauuuguaucuga

SEQ ID NO: 126885 - RNA, 1701 nt, Artificial Sequence; identical to SEQ ID NO: 125849
  derived and/or modified sequence opt3 from hemagglutinin__InfluenzaA__ADG42763

SEQ ID NO: 126886 - RNA, 1701 nt, Artificial Sequence; identical to SEQ ID NO: 125849
  derived and/or modified sequence opt3 from hemagglutinin__InfluenzaA__ADG42773

SEQ ID NO: 126887 - RNA, 1701 nt, Artificial Sequence
  derived and/or modified sequence opt3 from hemagglutinin__InfluenzaA__ADG42783
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcacugaucaacagaguuuguaccagaacgcugacgccuacguguucgucgggaccucucgcuauuccaagaaauuuaagccugagaucgcgauucgaccaaaagugcgugaucaggagggaagaaugaauuacuauuggacacugguggaacccggugacaagaucacuuucgaggcaaccggcaaccuagucguuccuagguacgccuuugcuauggaacggaacgccgggagcggaauuaucauaucggauacaccagugcaugacugcaauaccacgugucaaacuccgaaaggcgcaauuaacacaucucuccccuuccagaauauccacccuauuaccaucgguaagugcccaaaguauguaaaauccacuaagcugcgccuugcuacagggcugagaaacgugcccucaauccagaguaggggauuguuuggcgccauugcgggcuucauagaagggggauggaccgguauggucgacggcugguacggguaucaucaccagaaugaacaaggaagcggcuacgccgcagaucucaaauccacgcagaacgcuaucgacaagauuaccaauaaagugaacucuguuaucgagaagaugaauacacaguuuacugccguggguaaggaguucaaccaccuggaaaaacggauagagaauuuaaacaagaaagucgaugacggguuccuggauauuuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagaucgacggggucaaacuugagagcacaaggauuuaucaaauccuggccauuuacucuaccguggcuucaaguuugguccucgugguuagccugggagcgauauccuuuuggaugugcucuaacgguucguuacagugccggaucuguauuuga

SEQ ID NO: 126888 - RNA, 1701 nt, Artificial Sequence; identical to SEQ ID NO: 125849
  derived and/or modified sequence opt3 from hemagglutinin__InfluenzaA__ADG42793

SEQ ID NO: 126889 - RNA, 1701 nt, Artificial Sequence; identical to SEQ ID NO: 126887
  derived and/or modified sequence opt3 from hemagglutinin__InfluenzaA__ADG42803

SEQ ID NO: 126890 - RNA, 1701 nt, Artificial Sequence; identical to SEQ ID NO: 126237
  derived and/or modified sequence opt3 from hemagglutinin__InfluenzaA__ADG42813

SEQ ID NO: 126891 - RNA, 1701 nt, Artificial Sequence; identical to SEQ ID NO: 126380
  derived and/or modified sequence opt3 from hemagglutinin__InfluenzaA__ADG42823

SEQ ID NO: 126892 - RNA, 1701 nt, Artificial Sequence; identical to SEQ ID NO: 126282
  derived and/or modified sequence opt3 from hemagglutinin__InfluenzaA__ADG42833

SEQ ID NO: 126893 - RNA, 1701 nt, Artificial Sequence; identical to SEQ ID NO: 125849
  derived and/or modified sequence opt3 from hemagglutinin__InfluenzaA__ADG42843

SEQ ID NO: 126894 - RNA, 1701 nt, Artificial Sequence; identical to SEQ ID NO: 125849
  derived and/or modified sequence opt3 from hemagglutinin__InfluenzaA__ADG42853

SEQ ID NO: 126895 - RNA, 1701 nt, Artificial Sequence; identical to SEQ ID NO: 126403
  derived and/or modified sequence opt3 from hemagglutinin__InfluenzaA__ADG42863

SEQ ID NO: 126896 - RNA, 1701 nt, Artificial Sequence; identical to SEQ ID NO: 126423
  derived and/or modified sequence opt3 from hemagglutinin__InfluenzaA__ADG42883

SEQ ID NO: 126897 - RNA, 1701 nt, Artificial Sequence
  derived and/or modified sequence opt3 from hemagglutinin__InfluenzaA__ADG42893
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaaccugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126898 - RNA, 1701 nt, Artificial Sequence; identical to SEQ ID NO: 124685
  derived and/or modified sequence opt3 from hemagglutinin__InfluenzaA__ADG42903

SEQ ID NO: 126899 - RNA, 1701 nt, Artificial Sequence; identical to SEQ ID NO: 125849
  derived and/or modified sequence opt3 from hemagglutinin__InfluenzaA__ADG42913

SEQ ID NO: 126900 - RNA, 1701 nt, Artificial Sequence; identical to SEQ ID NO: 126413
  derived and/or modified sequence opt3 from hemagglutinin__InfluenzaA__ADG42923

SEQ ID NO: 126901 - RNA, 1701 nt, Artificial Sequence
  derived and/or modified sequence opt3 from hemagglutinin__InfluenzaA__ADG57087
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgaucucauugguccucgugguuagucugggagcaauuagcuuuuggaugugcuccaacgguucuuuacggugccguaucuguaucuga

SEQ ID NO: 126902 - RNA, 1701 nt, Artificial Sequence; identical to SEQ ID NO: 124685
  derived and/or modified sequence opt3 from hemagglutinin__InfluenzaA__ADG57088

SEQ ID NO: 126903 - RNA, 1701 nt, Artificial Sequence
  derived and/or modified sequence opt3 from hemagglutinin__InfluenzaA__ADG57089
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuauccaguacgaggagcucagggaacaacugagcaguguguccucuuucgagcgguuugaaauuuucccgaaaacaagcuccuggcccaaucacgacucaaacaagggugucaccgccgcuuguccucaugcaggggccaagaguuuuuauaaaaaucugaucuggcucgugaagaaaggaaacagcuacccaaaguuaucuaaauccuauauaaaugauaagggcaaggagguacugguucuuuggggcauccaccaccccucaacgagcgcugaccagcagaguuuguaccagaacgccgaugcguacguguucgucgggucuucccgcuauagcaaaaaguuuaaaccugagauugcaauccgaccaaaggugcgugaccaagaaggaagaaugaauuacuauuggacucugguggagcccggugauaaaauuaccuucgaagccacaggcaaccuagucguuccuagguacgcuuuugccauggagcggaacgcagggucgggaaucauaauuucugacacuccagugcaugauugcaauaccacaugucagaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcaaggauccggcuacgcagcugaccucaagucuacacagaacgccauugaugagaucaccaauaaagugaacagcguuauagaaaagaugaauacgcaguuuaccgcuguggguaaagaguucaaccaucuggaaaagcggauugagaauuuaaacaagaaagucgacgauggguuccuggacaucuggacauacaaugccgaacuccuugugcuguuggagaacgagcgcacucuagauuaucacgacucaaauguaaagaaccuguacgaaaaaguucgaagucagcucaagaacaaugcagaggaaaucggcaacggauguuuugaguucuaucauaaaugcgauaauaccuguauggaauccgugaagaacggcacauacgacuauccuaaguacagcgaggaggccaaacugaauagagaagagauugauggggucaaacuugaaucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 126904 - RNA, 1701 nt, Artificial Sequence
  derived and/or modified sequence opt3 from hemagglutinin__InfluenzaA__ADG57090
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguauuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugcccagcugcucgugcuucuggagaacgaacgcaccuuggacuaucaugauagcaauguuaaaaaccuauacgagaagguacgaucacaacugaaaaacaaugcaaaggagauuggcaacggauguuuugaguucuaucacaagugcgacaauacauguauggagagugugaaaaacggcacuuacgauuauccuaaguacuccgaagaggccaaacucaauagagaagagaucgacggggucaagcuggagagcaccaggauuuaucagauacuugcuaucuacucuacaguggcgucaagucuggucuuggugguuagccucggagcaauuuccuuuuggaugugcucuaacgguucgcugcagugccggaucuguaucuga

SEQ ID NO: 126905 - RNA, 1701 nt, Artificial Sequence
  derived and/or modified sequence opt3 from hemagglutinin__InfluenzaA__ADG57091
auggaggccauccuggugguccuccuuuacaccuucgcuacagcaaacgccgacacucugugcauuggauaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaacggggguggacuggaauggucgacgguugguacggcuaucaccaccagaaugagcagggguccggauacgcagcugaucucaagucuacacaaaacgccauugacgagaucaccaauaaagugaacagcguuauagaaaagaugaauacgcaguuuaccgcugugggcaaagaguucaaccaucuggaaaagcgcauugagaauuuaaacaagaaagucgaugacgguuuccuggauaucuggacauacaaugccgaacuccuugugcuguuggagaacgagcgaacucuagacuaucacgauucaaauguaaagaaccuguacgaaaaaguuagaagucagcucaagaacaaugcaaaagagaucgggaacggcuguuuugaguucuaucauaagugcgacaauaccuguauggaauccgugaagaacggaacauacgauuauccuaaauacagcgaagaggccaagcugaauagggaggaaauugacggcgucaaacuugagucuacucggaucuaucagauucuggcuauauacucaaccguggcgaguagcuugguccucgugguuucccugggggcaaucucuuuuuggaugugcucgaacggcagcuuacaaugccguauuuguaucuga

SEQ ID NO: 126906 - RNA, 1701 nt, Artificial Sequence
  derived and/or modified sequence opt3 from hemagglutinin__InfluenzaA__ADG57092
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaauaaagucuuauaucaaugacaagggcaaagaaguacugguucuuuggggcauucaccaccccuccacgucagcugaucaacagagcuuguaccagaacgccgacgcguacguguucgucgggaccagucgcuauucuaagaaauuuaagccugagaucgcaauucgaccaaaagugcgugaucaggagggaagaaugaauuacuauuggacucugguggaacccggugacaagaucacauucgaggccacuggcaaccuagucguuccuagguacgcuuuugccauggaacggaacgcaggguccggaauaauuaucagcgauaccccagugcaugacugcaauacaaccugucaaacgccgaaaggcgcuauuaacacuucgcuccccuuccagaauauccacccuaucacaauugguaagugcccaaaguauguaaaaucuaccaagcugcgccuugccacugggcugagaaacgugcccuccauacagucaaggggauuguuuggcgcgaucgccggcuucauugaagggggauggacagguauggucgacggcugguacggguaucaucaccagaaugaacaaggaaguggcuacgcagcugaucucaaaagcacccagaacgccaucgacgagauaacgaauaaggugaacuccguuauugagaaaaugaauacccaguuuacagcuguggguaaggaguucaaccaccuggaaaagcggaucgaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaauuggcaacggauguuuugaguucuaucacaagugcgacaauacauguauggaaucagugaaaaacggcacuuacgauuauccuaaguacagugaggaagccaaacugaauagagaggagaucgacggggucaaacuugaauccaccaggauuuaucaaauacuggcuaucuacagcacaguggcgucuucauugguccucgugguuagucugggagcaauuagcuuuuggaugugcuccaacgguucuuuacagugccggaucuguaucuga

SEQ ID NO: 126907 - RNA, 1701 nt, Artificial Sequence
  derived and/or modified sequence opt3 from hemagglutinin__InfluenzaA__ADG57093
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagauccugguacuuuggggcauucaccaccccucaacgagcgcugaucaacagaguuuguaccagaacgccgacgcguacguuuucguguggucuucccgcuauagcaaaaaguuuaaaccugagaucgcaauucgaccaaagguccgugaucaggaagggagaaugaauuacuauuggacucugguggagcccggagacaaaaucaccuucgaagccacagguaaccuacucgugccuagguacgcuuuugccauggagcggaacgcaggcucggggauaauuaucucugauacuccaguccaugacugcaauaccacaugucaaaccccgaagggagcuauuaacacgucccugcccuuccacaauauccauccuaucacuauuggcaaaugcccaaaguauguuaagucaacaaaacuucgccuggccaccgguuugagaaacgugcccaguauacagagcagggggcucuuuggagcgaucgccggcuucauugaaggcggguggacuggaaugguagacgguugguacggcuaucaccaccagaaugagcagggguccggauacgcagcugaucugaagucuacacaaaacgccaucgacgagauaaccaauaaagugaacagcgucauugaaaagaugaauacgcaguuuaccgcugugggcaaagaguucaaccauuuagaaaagcggaucgagaaucugaacaagaaaguugaugacgguuuccucgauaucuggacauacaaugccgaacuucugguguugcuagagaacgagcgcacucuggacuaucacgauucaaaugucaagaaccucuacgaaaaagugcgaagucagcugaagaacaaugcaaaagagauugggaacggcuguuuugaguucuaucauaagugcgacaauaccuguauggaauccguaaagaacggaacauacgauuauccuaaauacagcgaagaggccaaacuuaauagagaggaaaucgacggcguuaagcuggagucuacuaggauuuaucagauauuggcuaucuacucaaccguggcgaguagccucguccugguggucuccuuaggggcaauuucuuuuuggaugugcucgaacggaagccugcaaugccggaucuguaucuga

SEQ ID NO: 126908 - RNA, 1701 nt, Artificial Sequence
  derived and/or modified sequence opt3 from hemagglutinin__InfluenzaA__ADG57094
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugauagagagggaaggaugaauuacuauuggacccuggucgaacccggugacaagaucacauucgaggccacuggcaaccuaguugugccucgguacgcuuuugccauggaacgcaacgcagggagcggaauuaucauaucggauaccccaguacaugacugcaauacaaccugucagacgccgaaaggcgcuauuaacacuucucuccccuuccaaaauauccacccuauuacaaucgguaagugcccaaaguaugugaaauccaccaagcugagacuugccacugggcugaggaacguccccucaauccagagucggggauuguuuggcgcgauugccggcuucauagaagggggauggacagguaugguggacggcugguacggguaucaucaccagaaugaacagggaagcggcuacgcagcugaucucaaauccacccaaaacgccaucgacgagauuacgaauaagguuaacucugugaucgagaaaaugaauacccaguuuacagcugucgguaaggaguucaaccaccuggaaaagcgcauagaaaauuuaaacaaaaagguggaugacggguuccuggauauuuggacuuacaaugccgagcuccuuguacuguuggaaaacgagcgaacccuagacuaucaugauagcaauguuaaaaaccuguacgagaaggugagaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagggaggagaucgacggggugaaacuugaaagcacccggauuuaucagauccuggcuauuuacucuacagucgcgucaaguuuggugcucguugugagccugggagcaauauccuuuuggaugugcucuaacgguucguuacaaugccguaucuguauuuga

SEQ ID NO: 126909 - RNA, 1701 nt, Artificial Sequence; identical to SEQ ID NO: 124685
  derived and/or modified sequence opt3 from hemagglutinin__InfluenzaA__ADG57095

SEQ ID NO: 126910 - RNA, 1701 nt, Artificial Sequence
  derived and/or modified sequence opt3 from hemagglutinin__InfluenzaA__ADG57097
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcguggacaggaagguagaaugaauuacuauuggacucugguggagcccggcgauaaaauuaccuucgaagccacagggaaccuagucguuccuagguacgcuuuugccauggagcggaacgcaggaucgggcaucauaauuucugacacuccagugcaugauugcaauaccacaugucaaaccccgaagggugcuaucaacacgucccuccccuuccacaauauucauccuaucacuaucgggaaaugcccaaaguauguaaagucaacaaaacugcgccuugccaccggacugagaaacgugcccaguauucagagcaggggcuuguuuggcgcgauagccggguucaucgaaggagguuggacuggcauggucgacgggugguacggauaucaccaccagaaugagcagggcuccgguuacgcagcugaccucaagucuacacaaaacgccauugaugagaucaccaauaaagugaacagcguuauagaaaagaugaauacgcaguuuaccgcuguggggaaagaguucaaccaucuggaaaagcggauugagaauuuaaacaagaaagucgacgauggcuuccuggacaucuggacauacaaugccgaacuccuugugcuguuggagaacgagcgcacucuagauuaucacgacucaaauguaaagaaccuguacgaaaaaguucgaagucagcucaagaacaaugcaaaagagaucggaaacggcuguuuugaguucuaucauaagugcgauaauaccuguauggaauccgugaagaacgggacauacgacuauccuaaauacagcgaagaggccaagcugaauagagaggaaauugauggagucaaacuugagucuacuaggaucuaucagauucuggcuauauacucaaccguggcgaguagcuugguccucgugguuucccugggugcaaucucuuuuuggaugugcucgaacggcagcuuacaaugccggauuuguaucuga

SEQ ID NO: 126911 - RNA, 1701 nt, Artificial Sequence; identical to SEQ ID NO: 125849
  derived and/or modified sequence opt3 from hemagglutinin__InfluenzaA__ADG57098

SEQ ID NO: 126912 - RNA, 1701 nt, Artificial Sequence
  derived and/or modified sequence opt3 from hemagglutinin__InfluenzaA__ADG57099
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuaccgauacaccagugcacgacugcaauaccacgugucaaacuccgaaaggcgcuguaaacacaucgcuccccuuccagaauauccauccuauuaccaucgguaagugcccaaaguacgugaaaucuacuaagcugcgccuugccacagggcugagaaacguccccuccauccagucaaggggauuguuuggcgcgauugccggcuucauagaagggggauggaccgguaugguggacggcugguauggguaccaccaccagaaugaacaaggaaguggcuaugcagcugaucucaaaagcacgcagaacgccaucgacaagauuaccaauaaaguuaacuccgugaucgagaagaugaauacacaguuuacugcugucgguaaggaguucaaccaucuggaaaaacggauagagaauuuaaacaagaaaguggaugacggguuccuggauauuuggaccuacaaugccgaacuccuuguacuguuggagaacgaacgcacacuagacuaccacgauucuaauguuaagaaccuguaugagaaagugcgaagccagcucaagaacaaugcaaaggagaucggcaacggauguuuugaguucuaccauaaaugcgacaauacuuguauggaaucagucaagaacggcaccuaugauuacccuaaauauagugaagaggccaagcugaauagagaagagaucgacggggugaaacuugaguccacaaggauuuaccaaauccuggcuauuuauagcaccgucgcgucuucauuggugcucguugugagucugggagcaaucagcuuuuggaugugcuccaacgguucuuuacagugccggauauguauuuga

SEQ ID NO: 126913 - RNA, 1701 nt, Artificial Sequence
  derived and/or modified sequence opt3 from hemagglutinin__InfluenzaA__ADG57100
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuggugggaaggaguucaaccaccuggaaaaacggauugagaauuuaaacaagaaaguggaugacggcuuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagaucggaaacggcuguuuugaguucuaucacaaaugcgacaauacauguauggaaaguguuaagaacgggacuuacgauuauccuaaauacuccgaagaggccaagcugaauagagaagagauugacggagugaaacuugagagcaccaggaucuaucaaauucuggcuauauacucuacagucgcgucaaguuuggugcucgucgugagccugggugcaaucuccuuuuggaugugcucuaacggcucguuacagugccggauuuguaucuga

SEQ ID NO: 126914 - RNA, 1701 nt, Artificial Sequence; identical to SEQ ID NO: 124685
  derived and/or modified sequence opt3 from hemagglutinin__InfluenzaA__ADG58939

SEQ ID NO: 126915 - RNA, 1701 nt, Artificial Sequence; identical to SEQ ID NO: 124685
  derived and/or modified sequence opt3 from hemagglutinin__InfluenzaA__ADG58940

SEQ ID NO: 126916 - RNA, 1701 nt, Artificial Sequence
  derived and/or modified sequence opt3 from hemagglutinin__InfluenzaA__ADG58941
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucacgaaaaugagcagggaagcggcuacgccgcagaucucaaauccacgcaaaacgcuauugacgagaucaccaauaaggugaacucuguuauagaaaagaugaauacacaguuuacugccguggguaaggaguucaaccaccuggaaaagcggauugagaauuuaaacaaaaagaucgaugacggguuccuggauaucuggaccuacaaugcugaacuccuuguccuguuggagaacgagcgcacacuagacuaucaugauagcaaugugaaaaaccuguacgaaaagguacgaucacagcucaaaaacaaugccaaggagauuggcaacggauguuuugaguucuaucacaagugcgacaauacuuguauggaaaguguuaaaaacggcaccuacgauuauccuaaguacuccgaagaggcaaaacugaauagagaggaaaucgacggggugaaacuugagagcacaaggauuuaucagauacuggccaucuacucuaccgucgcuucaaguuuggugcucgucgugagccugggagcgauuuccuuuuggaugugcucuaacgguucguuacaaugccggaucuguaucuga

SEQ ID NO: 126917 - RNA, 1701 nt, Artificial Sequence
  derived and/or modified sequence opt3 from hemagglutinin__InfluenzaA__ADG58942
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucuccaucagaaugaacaaggaagcggcuacgccgcagaucugaaauccacgcagaacgcuauugacgagaucaccaauaaggugaacucuguuauagagaaaaugaauacacaguuuacugccguggguaaggaguucaaccacuuagaaaagcggauugaaaaucugaacaaaaagaucgaugacggguuccucgauaucuggaccuacaaugcugagcuucuggucuugcuagaaaacgagcgcacacuggacuaucacgauagcaaugugaaaaaccucuacgagaagguacgaucacagcugaaaaacaaugccaaggaaauuggcaacggauguuuugaguucuaucauaagugcgacaauacuuguauggaaaguguuaaaaacggcaccuacgauuauccuaaguacuccgaggaagcaaaacuuaauagagaggagaucgacggggugaagcuggaaagcacaaggauuuaucaaauauuggccaucuacucuaccgucgcuucaagucucgugcuggucgugagcuuaggagcgauuuccuuuuggaugugcucuaacgguucgcugcagugccggaucuguaucuga

SEQ ID NO: 126918 - RNA, 1701 nt, Artificial Sequence; identical to SEQ ID NO: 124685
  derived and/or modified sequence opt3 from hemagglutinin__InfluenzaA__ADG58943

SEQ ID NO: 126919 - RNA, 1701 nt, Artificial Sequence
  derived and/or modified sequence opt3 from hemagglutinin__InfluenzaA__ADG58944
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuacucgucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggacggcugguacggguaucaucaccagaaugaacaaggaagcggcuacgcagcugaucugaaguccacccagaacgccauugacgagaucacgaauaaggucaacucugugauagagaaaaugaauacccaguuuacagcuguugguaaggaguucaaccacuuagaaaagcggauugaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacuuaauagagaggagauugacggggugaagcuggaaagcaccaggaucuaucaaauuuuggcuauauacucuacagucgcgucaagucucgugcuggucgugagcuuaggagcaaucuccuuuuggaugugcucuaacgguucgcugcagugccggauuuguaucuga

SEQ ID NO: 126920 - RNA, 1701 nt, Artificial Sequence; identical to SEQ ID NO: 125483
  derived and/or modified sequence opt3 from hemagglutinin__InfluenzaA__ADG58946

SEQ ID NO: 126921 - RNA, 1701 nt, Artificial Sequence; identical to SEQ ID NO: 124685
  derived and/or modified sequence opt3 from hemagglutinin__InfluenzaA__ADG58947

SEQ ID NO: 126922 - RNA, 1701 nt, Artificial Sequence
  derived and/or modified sequence opt3 from hemagglutinin__InfluenzaA__ADG58948
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacacuuacguuuucguggggaccucucgcuauuccaagaaauuuaagccugagaucgcgauucgaccaaaaguccgugaucaggagggaagaaugaauuacuauuggacacugguggaacccggugacaagaucacuuucgaggcaaccggcaaccuaguggucccuagguacgccuuugcuauggaacggaacgccgggagcggaauaauuaucucggauacaccaguucaugacugcaauaccacgugucaaacuccgaaaggcgcaauuaacacaucucuccccuuccagaauauccacccuaucaccauugguaagugcccaaaguaugugaaauccacuaagcugcgccuugcuacagggcugagaaacguacccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagaucgaugacggguuccuggauauuuggaccuacaaugcugagcuccuugugcuguuggaaaacgagcgcacacuagacuaucaugauagcaaugucaaaaaccuguacgagaaggugcgaucacagcucaaaaacaaugccaaggaaaucggcaacggauguuuugaguucuaucacaagugcgacaauacuuguauggaaaguguaaagaacggcaccuacgauuauccuaaguacuccgaggaagcaaaacugaauagagaggagauugacgggguuaaacuugaaagcacaaggauauaucaaauccuggccauuuacucuaccguggcuucaaguuugguccucguggucagccugggagcgaucuccuuuuggaugugcucuaacgguucguuacagugccggaucuguauuuga

SEQ ID NO: 126923 - RNA, 1701 nt, Artificial Sequence
  derived and/or modified sequence opt3 from hemagglutinin__InfluenzaA__ADG58949
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaucugugcaugacugcaauaccacgugucaaacuccaaaaggcgcaaucaacacaucccucccguuccagaauauucaccccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugaacaaggauccggcuacgccgcagaucucaaaucuacgcagaacgcuauugacgagaucaccaauaaggugaacagcguuauagagaaaaugaauacacaguuuacugccguggguaaggaguucaaccaccuggaaaagcggauugaaaauuuaaacaaaaagaucgaugacggguuccuggauaucuggaccuacaaugcugagcuccuuguccuguuggaaaacgagcgcacacuagacuaucaugauucaaaugugaaaaaccuguacgagaagguacgaagucagcucaaaaacaaugccaaggaaauuggcaacggauguuuugaguucuaucacaagugcgacaauacuuguauggaauccguuaaaaacggcaccuacgauuaucccaaguacagcgaggaagcaaaacugaauagagaggagaucgacggggugaaacuugaaucuacaaggauuuaucaaauacuggccaucuacucaaccgucgcuaguagcuuggugcucgucgugucccugggagcgauuucuuuuuggaugugcucgaacgguagcuuacagugccggaucuguaucuga

SEQ ID NO: 126924 - RNA, 1701 nt, Artificial Sequence
  derived and/or modified sequence opt3 from hemagglutinin__InfluenzaA__ADG58951
augaaggccauccuggugguccuccuucacaccuucgcuacagcaaacgccgacacucugugcauuggcuaccaugcgaauaacagcacggauaccguugacacaguguuggagaaaaauguaacugugacccacuccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuauauuguugagaccucuaacucgggaaauggcacuugcuacccaggugaauuuaucgacuaugaggagcucagggaacagcugucaagcgugaguuccuucgagcgguuugaaauuuucccgaagacaucuagcuggcccaaccaugauuccaauaagggggucaccgccgcuuguccucacgcaggagccaaaucauuuuacaagaaccugaucuggcucgugaaaaagggcaauaguuauccaaaauuaagcaagucuuacauaaacgacaagggcaaagagguacugguucuuugggggauccaccaucccuccacgucagcugaucaacagagcuuguaucagaaugccgacgcguacguguucgucggaaccagucgcuacucuaagaaauuuaagccugagauugcaauccgaccaaaagugcgugaucaggaagguagaaugaacuauuacuggacucugguggagcccggcgacaagauuacauucgaagccacugggaaccuagucguuccuagguaugcuuuugccauggagcggaaugcaggauccggcaucauaauuagcgauaccccagugcacgacugcaacacaaccugucaaacgccgaaaggugcuaucaauacuucgcuccccuuccagaacauucauccuaucacaaucgggaagugcccaaaguacguaaaaucuaccaagcugcgccuugccacuggacugagaaaugugcccuccauucagucaaggggcuuguuuggcgcgauagccggguucaucgaaggagguuggacaggcauggucgaugggugguauggauaccaccaccagaacgagcaaggcagugguuaugcagcugaccucaaaagcacccagaaugccauugacgagaucacgaacaagguaaauuccguuauagaaaagaugaacacccaguuuacagcuguggggaaggaguucaaucaucuggaaaagcggauugagaacuuaaauaaaaaggucgaugacggcuuccuggauaucuggacuuacaacgccgaacuccuugugcuguuggagaaugagcgcacccuagacuaccacgauucuaacgugaaaaaccuguaugaaaagguucgaagccagcucaaaaauaacgcaaaggagaucggaaauggcuguuuugaguucuaccauaagugcgacaacacauguauugaaucagugaaaaaugggacuuaugauuacccuaaguauagugaagaggccaaacugaacagagaggaaaucgacggagucaaacuugaguccaccaggauuuaccaaauacuggcuaucuauagcacaguggcgucuucauugguccucgugguuagucugggugcaauuagcuuuuggaugugcuccaauggcucuuuacagugccggaucuguaucuga

SEQ ID NO: 126925 - RNA, 1701 nt, Artificial Sequence; identical to SEQ ID NO: 126924
  derived and/or modified sequence opt3 from hemagglutinin__InfluenzaA__ADG58952

SEQ ID NO: 126926 - RNA, 1701 nt, Artificial Sequence; identical to SEQ ID NO: 126924
  derived and/or modified sequence opt3 from hemagglutinin__InfluenzaA__ADG58953

SEQ ID NO: 126927 - RNA, 1701 nt, Artificial Sequence; identical to SEQ ID NO: 126924
  derived and/or modified sequence opt3 from hemagglutinin__InfluenzaA__ADG58954

SEQ ID NO: 126928 - RNA, 1701 nt, Artificial Sequence; identical to SEQ ID NO: 126924
  derived and/or modified sequence opt3 from hemagglutinin__InfluenzaA__ADG58955

SEQ ID NO: 126929 - RNA, 1701 nt, Artificial Sequence; identical to SEQ ID NO: 126924
  derived and/or modified sequence opt3 from hemagglutinin__InfluenzaA__ADG58956

SEQ ID NO: 126930 - RNA, 1701 nt, Artificial Sequence
  derived and/or modified sequence opt3 from hemagglutinin__InfluenzaA__ADG58957
augaaggccauccuggugguccuccuucacaccuucgcuacagcaaacgccgacacucugugcauuggcuaccaugcgaauaacagcacggauaccguugacacaguguuggagaaaaauguaacugugacccacuccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuauauuguugagaccucuaacucgggaaauggcacuugcuacccaggugaauuuaucgacuaugaggagcucagggaacagcugucaagcgugaguuccuucgagcgguuugaaauuuucccgaagacaucuagcuggcccaaccaugauuccaauaagggggucaccgccgcuuguccucacgcaggagccaaaucauuuuacaagaaccugaucuggcucgugaaaaagggcaauaguuauccaaaauuaagcaagucuuacauaaacgacaagggcaaagagguacugguucuuugggggauccaccaucccuccacgucagcugaucaacagagcuuguaucagaaugccgacgcguacguguucgucggaaccagucgcuacucuaagaaauuuaagccugagauugcaauccgaccaaaagugcgugaucaggaagguagaaugaacuauuacuggacucugguggagcccggcgacaagauuacauucgaagccacugggaaccuagucguuccuagguaugcuuuugccauggagcggaaugcaggauccggcaucauaauuagcgauaccccagugcacgacugcaacacaaccugucaaacgccgaaaggugcuaucaauacuucgcuccccuuccagaacauucauccuaucacaaucgggaagugcccaaaguacguaaaaucuaccaagcugcgccuugccacuggacugagaaaugugcccuccauucagucaaggggcuuguuuggcgcgauagccggguucaucgaaggagguuggacaggcauggucgaugggugguauggauaccaccaccagaacgagcaaggcagugguuaugcagcugaccucaaaagcacccagaaugccauugacgagaucacgaacaagguaaauuccguuauagaaaagaugaacacccaguuuacagcuguggggaaggaguucaaucaucuggaaaagcggauugagaacuuaaauaaaaaggucgaugacggcuuccuggauaucuggacuuacaacgccgaacuccuugugcuguuggagaaugagcgcacccuagacuaccacgauucuaacgugaaaaaccuguaugaaaagguucgaagccagcucaaaaauaacgcaaaggagaucggaaauggcuguuuugaguucuaccauaagugcgacaacacauguauggaaucagugaaaaaugggacuuaugauuacccuaaguauagugaagaggccaaacugaacagagaggaaauugacggagucaaacuugaguccaccaggaucuaccaaauucuggcuauauauagcacaguggcgucuucauugguccucgugguuagucugggugcaaucagcuuuuggaugugcuccaauggcucuuuacagugccggauuuguaucuga

SEQ ID NO: 126931 - RNA, 1701 nt, Artificial Sequence
  derived and/or modified sequence opt3 from hemagglutinin__InfluenzaA__ADG58959
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 126932 - RNA, 1701 nt, Artificial Sequence; identical to SEQ ID NO: 126849
  derived and/or modified sequence opt3 from hemagglutinin__InfluenzaA__ADG58960

SEQ ID NO: 126933 - RNA, 1701 nt, Artificial Sequence; identical to SEQ ID NO: 126849
  derived and/or modified sequence opt3 from hemagglutinin__InfluenzaA__ADG58961

SEQ ID NO: 126934 - RNA, 1701 nt, Artificial Sequence; identical to SEQ ID NO: 126849
  derived and/or modified sequence opt3 from hemagglutinin__InfluenzaA__ADG58962

SEQ ID NO: 126935 - RNA, 1701 nt, Artificial Sequence; identical to SEQ ID NO: 126849
  derived and/or modified sequence opt3 from hemagglutinin__InfluenzaA__ADG58963

SEQ ID NO: 126936 - RNA, 1701 nt, Artificial Sequence; identical to SEQ ID NO: 126849
  derived and/or modified sequence opt3 from hemagglutinin__InfluenzaA__ADG58964

SEQ ID NO: 126937 - RNA, 1701 nt, Artificial Sequence; identical to SEQ ID NO: 126849
  derived and/or modified sequence opt3 from hemagglutinin__InfluenzaA__ADG58965

SEQ ID NO: 126938 - RNA, 1701 nt, Artificial Sequence; identical to SEQ ID NO: 126849
  derived and/or modified sequence opt3 from hemagglutinin__InfluenzaA__ADG58966

SEQ ID NO: 126939 - RNA, 1701 nt, Artificial Sequence; identical to SEQ ID NO: 126849
  derived and/or modified sequence opt3 from hemagglutinin__InfluenzaA__ADG58967

SEQ ID NO: 126940 - RNA, 1701 nt, Artificial Sequence; identical to SEQ ID NO: 126849
  derived and/or modified sequence opt3 from hemagglutinin__InfluenzaA__ADG58968

SEQ ID NO: 126941 - RNA, 1701 nt, Artificial Sequence; identical to SEQ ID NO: 124685
  derived and/or modified sequence opt3 from hemagglutinin__InfluenzaA__ADG59628

SEQ ID NO: 126942 - RNA, 1701 nt, Artificial Sequence; identical to SEQ ID NO: 124685
  derived and/or modified sequence opt3 from hemagglutinin__InfluenzaA__ADG59629

SEQ ID NO: 126943 - RNA, 1701 nt, Artificial Sequence; identical to SEQ ID NO: 124685
  derived and/or modified sequence opt3 from hemagglutinin__InfluenzaA__ADG59630

SEQ ID NO: 126944 - RNA, 1701 nt, Artificial Sequence; identical to SEQ ID NO: 124685
  derived and/or modified sequence opt3 from hemagglutinin__InfluenzaA__ADG59631

SEQ ID NO: 126945 - RNA, 1701 nt, Artificial Sequence; identical to SEQ ID NO: 124685
  derived and/or modified sequence opt3 from hemagglutinin__InfluenzaA__ADG59632

SEQ ID NO: 126946 - RNA, 1701 nt, Artificial Sequence; identical to SEQ ID NO: 125786
  derived and/or modified sequence opt3 from hemagglutinin__InfluenzaA__ADG59633

SEQ ID NO: 126947 - RNA, 1701 nt, Artificial Sequence; identical to SEQ ID NO: 125786
  derived and/or modified sequence opt3 from hemagglutinin__InfluenzaA__ADG59634

SEQ ID NO: 126948 - RNA, 1701 nt, Artificial Sequence; identical to SEQ ID NO: 124685
  derived and/or modified sequence opt3 from hemagglutinin__InfluenzaA__ADG59635

SEQ ID NO: 126949 - RNA, 1701 nt, Artificial Sequence
  derived and/or modified sequence opt3 from hemagglutinin__InfluenzaA__ADG59636
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacauucccucaauacagaguaggggcuuguuuggcgcgaucgccggguucauugagggagguuggacaggcaugguggacgggugguacggauaucaucaccagaaugaacaaggcagcgguuacgcagcugaccucaaauccacccagaacgccaucgaugagauaacgaauaaggucaacucugugauugagaaaaugaauacccaguuuacagcuguugggaaggaguucaaccaccuggagaagcggaucgaaaauuuaaacaaaaagguggacgauggcuuccuggacaucuggacuuacaaugccgagcuccuuguccuguuggaaaacgagcgcacccuagauuaucaugacagcaaugugaaaaaccuguacgagaagguacgaucacagcucaaaaacaaugcaaaggaaauuggaaacggcuguuuugaguucuaucacaagugcgauaauacauguauggaaaguguuaaaaacgggacuuacgacuauccuaaguacuccgaggaagccaaacugaauagagaggagaucgauggagugaaacuugaaagcaccaggauuuaucaaauacuggcuaucuacucuacagucgcgucaaguuuggugcucgucgugagccugggugcaauuuccuuuuggaugugcucuaacggcucguuacagugccggaucuguaucuga

SEQ ID NO: 126950 - RNA, 1701 nt, Artificial Sequence; identical to SEQ ID NO: 125433
  derived and/or modified sequence opt3 from hemagglutinin__InfluenzaA__ADG59638

SEQ ID NO: 126951 - RNA, 1701 nt, Artificial Sequence; identical to SEQ ID NO: 125786
  derived and/or modified sequence opt3 from hemagglutinin__InfluenzaA__ADG59639

SEQ ID NO: 126952 - RNA, 1701 nt, Artificial Sequence; identical to SEQ ID NO: 125038
  derived and/or modified sequence opt3 from hemagglutinin__InfluenzaA__ADG59641

SEQ ID NO: 126953 - RNA, 1701 nt, Artificial Sequence; identical to SEQ ID NO: 125528
  derived and/or modified sequence opt3 from hemagglutinin__InfluenzaA__ADG59643

SEQ ID NO: 126954 - RNA, 1701 nt, Artificial Sequence; identical to SEQ ID NO: 124672
  derived and/or modified sequence opt3 from hemagglutinin__InfluenzaA__ADG59644

SEQ ID NO: 126955 - RNA, 1701 nt, Artificial Sequence; identical to SEQ ID NO: 124685
  derived and/or modified sequence opt3 from hemagglutinin__InfluenzaA__ADG59646

SEQ ID NO: 126956 - RNA, 1701 nt, Artificial Sequence; identical to SEQ ID NO: 125786
  derived and/or modified sequence opt3 from hemagglutinin__InfluenzaA__ADG59647

SEQ ID NO: 126957 - RNA, 1701 nt, Artificial Sequence; identical to SEQ ID NO: 125849
  derived and/or modified sequence opt3 from hemagglutinin__InfluenzaA__ADG59648

SEQ ID NO: 126958 - RNA, 1701 nt, Artificial Sequence; identical to SEQ ID NO: 125849
  derived and/or modified sequence opt3 from hemagglutinin__InfluenzaA__ADG59649

SEQ ID NO: 126959 - RNA, 1701 nt, Artificial Sequence; identical to SEQ ID NO: 125849
  derived and/or modified sequence opt3 from hemagglutinin__InfluenzaA__ADG59650

SEQ ID NO: 126960 - RNA, 1701 nt, Artificial Sequence; identical to SEQ ID NO: 125849
  derived and/or modified sequence opt3 from hemagglutinin__InfluenzaA__ADG59651

SEQ ID NO: 126961 - RNA, 1701 nt, Artificial Sequence; identical to SEQ ID NO: 124685
  derived and/or modified sequence opt3 from hemagglutinin__InfluenzaA__ADG59652

SEQ ID NO: 126962 - RNA, 1701 nt, Artificial Sequence; identical to SEQ ID NO: 124685
  derived and/or modified sequence opt3 from hemagglutinin__InfluenzaA__ADG59653

SEQ ID NO: 126963 - RNA, 1701 nt, Artificial Sequence; identical to SEQ ID NO: 126949
  derived and/or modified sequence opt3 from hemagglutinin__InfluenzaA__ADG59655

SEQ ID NO: 126964 - RNA, 1701 nt, Artificial Sequence; identical to SEQ ID NO: 125786
  derived and/or modified sequence opt3 from hemagglutinin__InfluenzaA__ADG59656

SEQ ID NO: 126965 - RNA, 1701 nt, Artificial Sequence
  derived and/or modified sequence opt3 from hemagglutinin__InfluenzaA__ADG59657
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguacucagagcagaggauuguuuggcgcgauugccggcuucauagaagggggauggacagguauggucgacggcugguacggguaucaucaccagaaugaacaaggauccggcuacgcagcugaucucaagucuacccagaacgccaucgacgagauuacgaauaaagugaacagcguuaucgagaagaugaauacccaguuuacagcuguggguaaggaauuuaaccaccuggagaaaaggauagaaaauuuaaacaagaaagucgaugacggguuccuggauauuuggacuuacaaugccgagcuccuugugcuguuggaaaacgagcggacccuagacuaucaugauucaaauguaaagaaccuguacgagaaaguucgcagucagcucaagaacaaugcaaaggaaaucggcaacggauguuucgaguucuaucacaaaugcgacaauacauguauggaauccgugaagaacggcacuuacgauuauccuaaauacagcgaggaagccaagcugaaucgagaggagaucgacggggucaaacuugaaucuaccagaauuuaucaaauccuggcuauuuacucaacaguggcgaguagcuugguccucgugguuucccugggagcaauaucuuuuuggaugugcucgaacgguagcuuacagugcaggaucuguauuuga

SEQ ID NO: 126966 - RNA, 1701 nt, Artificial Sequence
  derived and/or modified sequence opt3 from hemagglutinin__InfluenzaA__ADG59658
augaaggccauccuggugguccuccuuuacaccuucgcuacagcaaacgccgacacucugugcauuggcuaucacgcgaauaacagcacggauaccauagacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccguaaucaggagggaagaaugaacuacuauuggacccugguggaacccggugauaagaucacauucgaggccacuggcaaccuaguggucccuagguacgcuuuugccauggaacggaaugcagggagcggaauaauuaucucggacaccccaguucaugauugcaacacaaccugucaaacgccgaaaggcgcuauuaauacuucucuccccuuccagaacauccacccuaucacaauugguaagugcccaaaguaugugaaauccaccaagcugcgccuugccacugggcugagaaauauacccucaauccagaguaggggauuguuuggcgcgauugccggcuucaucgaagggggauggacagguaugguagacggcugguacggguaucaucaccagaacgaacaaggaagcggcuacgcagcugaccucaaauccacccagaaugccauagaugagauuacgaacaagguaaauucugucaucgagaaaaugaacacccaguuuacagcuguggguaaggaguucaaucaccuggaaaagcggaucgaaaacuuaaauaaaaagguugacgauggguuccuggacauuuggacuuacaacgccgagcuccuugugcuguuggaaaaugagcgcacccuagauuaucaugacagcaacgucaaaaaccuguacgagaaggugcgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugaugggguuaaacuugaaagcaccaggauauaucaaauccuggcuauuuacucuacaguggcgucaaguuugguccucguggucagccugggagcaaucuccuuuuggaugugcucuaaugguucguuacagugccggaucuguauuuga

SEQ ID NO: 126967 - RNA, 1701 nt, Artificial Sequence; identical to SEQ ID NO: 125132
  derived and/or modified sequence opt3 from hemagglutinin__InfluenzaA__ADG59659

SEQ ID NO: 126968 - RNA, 1701 nt, Artificial Sequence; identical to SEQ ID NO: 125132
  derived and/or modified sequence opt3 from hemagglutinin__InfluenzaA__ADG59660

SEQ ID NO: 126969 - RNA, 1701 nt, Artificial Sequence; identical to SEQ ID NO: 125038
  derived and/or modified sequence opt3 from hemagglutinin__InfluenzaA__ADG59662

SEQ ID NO: 126970 - RNA, 1701 nt, Artificial Sequence
  derived and/or modified sequence opt3 from hemagglutinin__InfluenzaA__ADG59663
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccauuccaugacugcaauacaaccugucaaacgccgaaaggcgcuaucaacacuucucuccccuuucagaauauucacccuaucacaaucgguaagugcccaaaguaugugaaauccaccaagcugcgccuugccacugggcugagaaacauucccucaauacagaguaggggauuguucggcgcgaucgccggcuuuauugaagggggauggacagguaugguagacggcugguacggguaucaucaccagaaugaacaaggaagcggcuacgcagcugaucucaaauccacccagaacgccaucgacgagauaacgaauaaggugaacucugucauugagaaaaugaauacccaguucacagcuguggguaaggaguucaaccaccuggaaaagcggaucgaaaauuuaaacaaaaagguugaugacggguuucuggauaucuggacuuacaaugccgagcuccuugugcuguuggaaaacgagcgcacccuagacuaucaugauagcaaugucaaaaaccuguacgagaaggugcgaucacagcucaaaaacaaugcaaaggaaauuggcaacggauguuucgaguuuuaucacaagugcgacaauacauguauggaaaguguaaagaacggcacuuacgauuauccuaaguacuccgaggaagccaaacugaauagagaggagaucgacgggguuaaacuugaaagcaccaggauuuaucaaauacuggcuaucuacucuacaguggcgucaaguuugguccucguggucagccugggagcaauuuccuucuggaugugcucuaacgguucguuacagugccggaucuguaucuga

SEQ ID NO: 126971 - RNA, 1701 nt, Artificial Sequence; identical to SEQ ID NO: 125038
  derived and/or modified sequence opt3 from hemagglutinin__InfluenzaA__ADG59664

SEQ ID NO: 126972 - RNA, 1701 nt, Artificial Sequence
  derived and/or modified sequence opt3 from hemagglutinin__InfluenzaA__ADG59666
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacgggaugcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguuaauucugugauagagaaaaugaacacccaguuuacagcuguggguaaggaguucaaucaccuggaaaagcggauugaaaacuuaaauaaaaagaucgacgauggguuccuggacaucuggacuuacaacgccgagcuccuuguccuguuggaaaaugagcgcacccuagauuaucaugacagcaacgugaaaaaucuguacgagaagguacgaucacagcucaaaaacaacgcaaaggaaauuggcaauggauguuuugaguucuaucacaagugcgauaacacauguauggaaaguguuaaaaauggcacuuacgacuauccuaaguacuccgaggaagccaaacugaacagagaggagaucgauggggugaaacuugaaagcaccaggauuuaucaaauacuggcuaucuacucugcggucgcaucaaguuuggugcucgucgugagccugggagccauuuccuuuuggaugugcucuaaugguucguuacagugccggaucuguaucuga

SEQ ID NO: 126973 - RNA, 1701 nt, Artificial Sequence; identical to SEQ ID NO: 125787
  derived and/or modified sequence opt3 from hemagglutinin__InfluenzaA__ADG59667

SEQ ID NO: 126974 - RNA, 1701 nt, Artificial Sequence
  derived and/or modified sequence opt3 from hemagglutinin__InfluenzaA__ADG59669
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggaucccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 126975 - RNA, 1701 nt, Artificial Sequence; identical to SEQ ID NO: 126974
  derived and/or modified sequence opt3 from hemagglutinin__InfluenzaA__ADG59670

SEQ ID NO: 126976 - RNA, 1701 nt, Artificial Sequence; identical to SEQ ID NO: 126974
  derived and/or modified sequence opt3 from hemagglutinin__InfluenzaA__ADG59671

SEQ ID NO: 126977 - RNA, 1701 nt, Artificial Sequence; identical to SEQ ID NO: 126974
  derived and/or modified sequence opt3 from hemagglutinin__InfluenzaA__ADG59672

SEQ ID NO: 126978 - RNA, 1701 nt, Artificial Sequence
  derived and/or modified sequence opt3 from hemagglutinin__InfluenzaA__ADG59673
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuuggugagugcaauauagccggcuggauccuggggaacccugaaugugagucuuugucaacagcaaguagcugguccuacauuguugaaaccucuucgucagauaauggaacuugcuauccaggcgacuuuaucgauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggacuucucgcuauuccaaaaaguuuaaaccugagauugcaauccgaccaaaggugcgugaccaggaaggaagaaugaacuacuauuggacccugguggagcccggugauaaaauuacauucgaagccacuggcaaucuagucguuccuagguacgcuuuugccauggagcggaacgcagggagcggaaucauaauuucggacaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgauggcugguacggguaucaucaccagaacgagcaaggaagcggcuacgcagcugaccucaaguccacccagaaugccauugaugagaucacgaacaaaguuaauucugugauagaaaagaugaacacccaguuuacagcuguggguaaagaguucaaucaccuggaaaagcggauugagaacuuaaauaagaaagucgacgauggguuccuggacaucuggacuuacaacgccgaacuccuugugcuguuggagaaugagcgcacccuagauuaucaugacagcaacguaaagaaucuguacgaaaaaguucgaucacagcucaagaacaacgcaaaagagaucggcaauggauguuuugaguucuaucacaagugcgauaacacauguauggaaagugugaagaauggcacuuacgacuauccuaaauacuccgaagaggccaagcugaacagagaggaaauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126979 - RNA, 1701 nt, Artificial Sequence
  derived and/or modified sequence opt3 from hemagglutinin__InfluenzaA__ADG59674
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaagaacucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugagcaggaaggaagaaugaauuacuauuggacccuggucgagcccggugauaagaucacauucgaagccacuggcaaccuaguugugccuagguacgcuuuugccauggagcggaacgcagggagcggaauuaucauaucggacaccccaguacaugauugcaauacaaccugucaaacgccgaaaggcgcuauuaacacuucucuccccuuccagaaugugcacccuaucacaauugguaagugcccaaaguaugucaaauccaccaagcugcgccuugccacugggcugagaaacgugcccucaauccagaguaggggauuguuuggcgcgaucgccggcuucauugaagggggauggacagguaugguugacggcugguacggguaucaucaccagaaugagcaaggaagcggcuacgcagcugaccucaaauccacccagaacgccauagaugagaucacgaauaaggugaacucugucauugagaaaaugaauacccaguuuacagcuguggguaaggaguucaaccaccuggaaaagcggaucgagaauuuaaacaaaaagguagacgauggguuccuggacauauggacuuacaaugccgaacuccuuguucuguuggagaacgagcgcacccuagauuaucaugacagcaaugugaaaaaccuguacgaaaagguccgaucacagcucaaaaacaaugcaaaggagauuggcaacggauguuuugaguucuaucacaagugcgauaauacauguauggaaagugugaaaaacggcacuuacgacuauccuaaguacuccgaagaggccaaacugaauagagaggaaaucgauggggucaaacuugagagcaccaaaaucuaucaaauucuggcuaucuacucuacaguggcgucaaguuugguucucgugguaagccugggagcaauuuccuuuuggaugugcucuaacgguucguuacagugcaggauauguaucuga

SEQ ID NO: 126980 - RNA, 1701 nt, Artificial Sequence
  derived and/or modified sequence opt3 from hemagglutinin__InfluenzaA__ADG59675
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaacggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgacggcugguacggguaucaccaccagaacgaacagggauccggcuacgcagcugaucucaagucuacacaaaaugccauugacgagaucaccaacaaagugaauagcguuauagagaagaugaacacgcaguuuaccgcuguggguaaagaguucaaucaucuggaaaagcggauugaaaacuuaaauaagaaagucgaugacggguuccuggauaucuggacauacaacgccgagcuccuugugcuguuggaaaaugagcgcacucuagacuaucacgauucaaacguaaagaaccuguacgagaaaguucgaagucagcucaagaauaacgcaaaagaaaucggcaauggauguuuugaguucuaucauaagugcgacaacaccuguauggaauccgugaagaauggcacauacgauuauccuaaauacagcgaggaagccaagcugaacagagaggagauugacggggucaaacuugaaucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 126981 - RNA, 1701 nt, Artificial Sequence
  derived and/or modified sequence opt3 from hemagglutinin__InfluenzaA__ADG59676
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaaugcuacaugucaaaccccgaaaggcgccaucaacacgucucuccccuuccagaauauucacccuaucacuaucgguaagugcccaaaguauguaaaauccacaaagcugcgccuugcgaccgggcugagaaacauucccucaauacagaguaggggauuguuuggcgccaucgcaggcuucauugaagggggauggacugguaugguggacggcugguacggguaucaucaccagaaugaacaaggaagcggcuacgcugccgaucucaaauccacacagaacgcuaucgacgagauaaccaauaaggucaacucugugauugagaaaaugaauacgcaguuuaccgccguugguaaggaguucaaccaccuggaaaagcggaucgaaaauuuaaacaaaaagguggaugacggguuccuggauaucuggacauacaaugcagagcuccuuguccuguuggaaaacgagcgcacucuagacuaucaugauagcaaugugaaaaaccuguacgagaagguacgaucacagcucaaaaacaaugccaaggaaauuggcaacggauguuuugaguucuaucacaagugcgacaauaccuguauggaaaguguuaaaaacggcacauacgauuauccuaaguacuccgaggaagcuaaacugaauagagaggagaucgacggggugaaacuugaaagcacuaggauuuaucaaauacuggcgaucuacucuaccgucgcaucaaguuuggugcucgucgugagccugggagccauuuccuuuuggaugugcucuaacgguucguuacagugccggaucuguaucuga

SEQ ID NO: 126982 - RNA, 1701 nt, Artificial Sequence; identical to SEQ ID NO: 125786
  derived and/or modified sequence opt3 from hemagglutinin__InfluenzaA__ADG59678

SEQ ID NO: 126983 - RNA, 1701 nt, Artificial Sequence; identical to SEQ ID NO: 126949
  derived and/or modified sequence opt3 from hemagglutinin__InfluenzaA__ADG59680

SEQ ID NO: 126984 - RNA, 1701 nt, Artificial Sequence; identical to SEQ ID NO: 126949
  derived and/or modified sequence opt3 from hemagglutinin__InfluenzaA__ADG59681

SEQ ID NO: 126985 - RNA, 1701 nt, Artificial Sequence
  derived and/or modified sequence opt3 from hemagglutinin__InfluenzaA__ADG59683
augaaggccauccuggugguccuccuuuacaccuucgcuauugcaaacgccgacacacugugcauaggcuaucacgcgaauaacagcacugauacgguugacaccguguugaaaaagaauguaacagugacucauuccgucaacuuacuggaggauaaacacaaugggaagcuauguaaacucagaggaguggcuccccugcaucuugguaagugcaacaucgccggcuggauucuggggaauccugaaugugagucuuugucaaccgcaaguagcugguccuacaucguugaaacaucuucgucagacaacggaaccugcuauccaggcgauuuuauugacuacgaggaacucagggagcagcugagcaguguguccucuuucgagcgguuugaaaucuucccgaagacuagcuccuggcccaaucacgauucaaacaaaggugucacagccgcuuguccucaugcaggggccaagaguuuuuauaaaaaucugauauggcucgugaagaaaggaaacagcuacccaaaguuaucuaaguccuauaucaaugacaaaggcaaggagguacugguucuuuggggcauucaccaccccucaaccagcgcugaucaacagaguuuguaccagaacgccgacgcguacguguucgucgggacgucucgcuauuccaaaaaguuuaaaccugaaaucgcaauucgaccaaaggugcgugaucaggagggaagaaugaauuacuauuggacucugguggagcccggugacaaaaucaccuucgaagccacaggcaaccuagucguuccuagguacgcuuuugccauggagcggaacgcagggagcggaauagugauuucggauacuccaguacaugacugcaauaccacaugucaaaccccgaagggcgcuaucaacacgucucuccccuuccagaauauucacccuaucacuaucgguaagugcccaaaauaugugaaguccacaaaacugcgccuugccaccgggcugagaaacguccccucaauucagaguaggggauuguuuggcgcgauagccggcuucaucgaagggggauggacugguaugguggacggcugguacggguaucaucaccagaaugagcaaggaagcggcuacgcagcugaucucaaguccacacagaacgccauugacgaaaucaccaauaaaguuaacucugugauagagaagaugaauacgcaguuuaccgcugucgguaaggaguucaaccaccuggaaaaacggauugagaauuuaaacaagaaaguggaugacggguuccuggauaucuggacauacaaugccgaacuccuuguacuguuggagaacgaacgcacucuagacuaucaugauagcaauguuaagaaccuguacgagaaagugcgaucacagcucaagaacaaugcaaaggagaucggcaacggauguuuugaguucuaucacaaaugcgacaauaccuguauggaaagugucaagaacggcacauacgauuauccuaaauacuccgaagaggccaagcugaauagagaagagauugacggggugaaacuugagagcacuaggaucuaucaaauucuggcuauauacucuaccgucgcgucaaguuuggugcucguugugagccugggagcaaucuccuuuuggaugugcucuaacgguucguuacagugccggauuuguaucuga

SEQ ID NO: 126986 - RNA, 1701 nt, Artificial Sequence; identical to SEQ ID NO: 125786
  derived and/or modified sequence opt3 from hemagglutinin__InfluenzaA__ADG59684

SEQ ID NO: 126987 - RNA, 1701 nt, Artificial Sequence
  derived and/or modified sequence opt3 from hemagglutinin__InfluenzaA__ADG59685
augaaggccauccuggugguccuccuuuacaccuucgcuacagcaaacgccgacacucugugcauuggcuaucacgcgaauaacagcacggauaccauagacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacauacccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 126988 - RNA, 1701 nt, Artificial Sequence; identical to SEQ ID NO: 125786
  derived and/or modified sequence opt3 from hemagglutinin__InfluenzaA__ADG59686

SEQ ID NO: 126989 - RNA, 1701 nt, Artificial Sequence; identical to SEQ ID NO: 126949
  derived and/or modified sequence opt3 from hemagglutinin__InfluenzaA__ADG59687

SEQ ID NO: 126990 - RNA, 1701 nt, Artificial Sequence
  derived and/or modified sequence opt3 from hemagglutinin__InfluenzaA__ADG59688
augaaggccauccuggugguccuccuuuacaccauugcuacagcaaacgccgacacucugugcauaggcuaucacgcgaauaacagcacggauaccaucgacacaguuuuggagaaaaaugugacuguaacccauuccgugaacuuacuggaagauaagcacaaugggaaacuauguaagcucagaggagucgcuccccugcaucuugguaaaugcaacauugccggcuggauccuggggaauccugagugugaaucuuugucaacagcaaguagcugguccuacauuguggagaccucuucgucagacaacggaacuugcuauccaggcgauuucaucgacuacgaggaacucagggagcagcugagcaguguuuccucuuuugaacgguucgagauauuuccgaagacaagcuccuggcccaaucacgauucaaacaagggugugaccgccgcuuguccucaugcaggggccaaaaguuucuauaagaaucugaucuggcucgucaaaaagggaaacagcuacccaaaauuaucuaaguccuauauuaaugacaagggcaaagaagugcugguacuuuggggcauccaccaccccucaacgagcgcugaucaacagaguuuguaccagaacgccgacgcguacguuuuuguggggacuucucgcuauuccaagaaauucaagccugagauugcaauccgaccaaaaguccguggacaggaggguagaaugaauuacuauuggacccugguggaacccggcgauaagauaacauuugaggccacugggaaccuaguggucccuagguacgcuuucgccauggaacggaacgcaggaagcggcauuaucauuucggacaccccaguucaugauugcaauacaaccugucaaacgccgaaaggugcuaucaacacuucucuccccuuucagaauauccacccuauuacaauagggaagugcccaaaguaugugaaauccaccaagcugcgccuugccacuggacugagaaacauccccucaauucagaguaggggcuuguucggcgcgaucgccggguuuauagagggagguuggacaggcaugguagacgggugguacggauaucaucaccagaaugaacaaggcagcgguuacgcagcugaccucaaauccacccagaacgccauugaugagaucacgaauaaggugaacucugucaucgagaaaaugaauacccaguucacagcuguggggaaggaauuuaaccaccuggagaagcggauugaaaauuuaaacaaaaagguugacgauggcuuccuggacaucuggacuuacaaugccgagcuccuugugcuguuggaaaacgagcgcacccuagauuaucaugacagcaaugucaaaaaccuguacgagaaggugcgaucacagcucaaaaacaaugcaaaggaaauuggaaacggcuguuucgaguuuuaucacaagugcgauaauacauguauggaaaguguaaagaacgggacuuacgacuauccuaaguacuccgaggaagccaaacugaauagagaggagauagauggaguuaaacuugaaagcaccaggaucuaucaaauucuggcuaucuacucuacaguggcgucaaguuugguccucguggucagccugggugcaaucuccuucuggaugugcucuaacggcucguuacagugccggauuuguauauga

SEQ ID NO: 126991 - RNA, 1701 nt, Artificial Sequence; identical to SEQ ID NO: 124685
  derived and/or modified sequence opt3 from hemagglutinin__InfluenzaA__ADG59689

SEQ ID NO: 126992 - RNA, 1701 nt, Artificial Sequence; identical to SEQ ID NO: 124685
  derived and/or modified sequence opt3 from hemagglutinin__InfluenzaA__ADG59691

SEQ ID NO: 126993 - RNA, 1701 nt, Artificial Sequence
  derived and/or modified sequence opt3 from hemagglutinin__InfluenzaA__ADG59693
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguaaucaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaccucaaauccacccagaaugccaucgaugagauaacgaacaaggucaauucugugauugagaaaaugaacacccaguuuacagcuguugguaaggaguucaaucaccuggaaaagcggaucgaaaacuuaaauaaaaagguggacgauggguuccuggacaucuggacuuacaacgccgagcuccuuguccuguuggaaaaugagcgcacccuagauuaucaugacagcaacgugaaaaaccuguacgagaagguacgaucacagcucaaaaauaacgcaaaggaaauuggcaauggauguuuugaguucuaucacaagugcgauaacacauguauggaaaguguuaaaaauggcacuuacgacuauccuaaguacuccgaggaagccaaacugaacagagaggagaucgauggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 126994 - RNA, 1701 nt, Artificial Sequence
  derived and/or modified sequence opt3 from hemagglutinin__InfluenzaA__ADG59696
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcgggacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaucucaaauccacccagaaugccauugacgagaucacgaacaagguaaauucuguuauagaaaagaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugagcgcacccuagacuaucaugauagcaacgugaaaaaucuguacgaaaagguucgaucacagcucaaaaacaacgcaaaggagaucggcaauggauguuuugaguucuaucacaagugcgacaacacauguauggagagugugaaaaauggcacuuacgauuauccuaaguacuccgaagaggccaaacugaacagagaggaaauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 126995 - RNA, 1701 nt, Artificial Sequence
  derived and/or modified sequence opt3 from hemagglutinin__InfluenzaA__ADG59697
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaauuuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcguggacaggaggguagaaugaacuacuauuggacccugguggaacccggcgauaagauuacauucgaggccacugggaaccuagucguuccuagguacgcuuuugccauggaacggaaugcaggauccggcaucauaauuagcgacaccccagugcaugauugcaacacaaccugucaaacgccgaaaggugcuaucaauacuucgcuccccuuccagaacauucacccuaucacaaucgggaagugcccaaaguauguaaaaucuaccaagcugcgccuugccacuggacugagaaaugugcccuccauucagucaaggggcuuguuuggcgcgauagccggguucaucgagggagguuggacaggcauggucgacgggugguacggauaucaucaccagaacgaacaaggcagugguuacgcagcugaccucaaaagcacccagaaugccauugaugagaucacgaacaaggugaauaguguuauagagaaaaugaacacccaguuuacagcuguggggaaggaguucaaucaccuggagaagcggauugaaaacuuaaauaaaaaggucgacgauggcuuccuggacaucuggacuuacaacgccgagcuccuugugcuguuggaaaaugagcgcacccuagauuaucaugacucuaacguaaagaaccuguacgagaagguucgaagccagcucaaaaauaacgcaaaggaaaucggaaauggcuguuuugaguucuaucacaagugcgauaacacauguauggaaucagugaaaaaugggacuuacgacuauccuaaguacagugaggaagccaaacugaacagagaggagauugauggagucaaacuugaauccaccaggaucuaucaaauucuggcuauauacagcacaguggcgucuucauugguccucgugguuagucugggugcaaucagcuuuuggaugugcuccaauggcucuuuacagugccggauuuguaucuga

SEQ ID NO: 126996 - RNA, 1701 nt, Artificial Sequence
  derived and/or modified sequence opt3 from hemagglutinin__InfluenzaA__ADG59700
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgcucaaaggcgcuaucaacacuucucugccguuccagaauauucaccccaucacaaucgguaagugcccuaaguauguaaaauccaccaaacuucgccuggccacuggguugagaaacauuccaucaauacagaguaggggacucuuuggcgcgaucgccggcuucauugaagggggauggacagguaugguggacggcugguacggguaucaucaccagaaugaacaaggaagcggcuacgcagcugaucugaaguccacccagaacgccaucgacgagauaacgaauaaggucaacucugugauugagaaaaugaauacccaguuuacagcuguugguaaggaguucaaccacuuagaaaagcggaucgaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaauuggcaacggauguuuugaguucuaucacaagugcgacaauacauguauggaaaguguuaaaaacggcacuuacgauuaucccaaguacuccgaggaagccaaacuuaauagagaggagaucgacggggugaagcuggaaagcaccaggauuuaucaaauauuggcuaucuacucuacagucgcgucaagucucgugcuggucgugagcuuaggagcaauuuccuuuuggaugugcucuaacgguucgcugcagugccggaucuguaucuga

SEQ ID NO: 126997 - RNA, 1701 nt, Artificial Sequence
  derived and/or modified sequence opt3 from hemagglutinin__InfluenzaA__ADG59701
augaaggccauccuggugguccuccuuuacaccuucgcugcagccaacgcggacacacugugcauuggcuaucacgcuaauaacagcacugauacgguugacaccguguuggagaaaaauguaacagugacucauuccgucaacuuacuggaagauaagcacaaugggaaacuauguaagcucagaggaguggcaccccugcaucuugguaaaugcaacauagccggcuggauccuggggaauccugagugugaaucuuugucaaccgccaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacaagaucaccaauaaagugaacucuguuauagagaagaugaauacgcaguuuaccgccguggguaaggaguucaaccaccuggaaaaacggauugagaauuuaaacaagaaagucgaugacggguuccuggauaucuggacauacaaugcagaacuccuugugcuguuggagaacgaacgcacucuagacuaucaugauagcaauguaaagaaccuguacgagaaaguucgaucacagcucaagaacaaugccaaggagaucggcaacggauguuuugaguucuaucacaaaugcgacaauaccuguauggaaagugugaagaacggcacauacgauuauccuaaauacuccgaagaggcuaagcugaauagagaagagauugacggggucaaacuugagagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 126998 - RNA, 1701 nt, Artificial Sequence
  derived and/or modified sequence opt3 from hemagglutinin__InfluenzaA__ADG59702
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcaaucuagacuaucaugauagcaacgugaaaaaccuguacgagaagguacgaucacagcucaaaaauaacgcaaaggaaauuggcaauggauguuuugaguucuaucacaagugcgacaacaccuguauggaaaguguuaaaaauggcacauacgauuauccuaaguacuccgaggaagccaaacugaacagagaggagaucgacggggugaaacuugaaagcacuaggauuuaucaaauacuggcuaucuacucuaccgucgcgucaaguuuggugcucgucgugagccugggagcaauuuccuuuuggaugugcucuaaugguucguuacagugccggaucuguaucuga

SEQ ID NO: 126999 - RNA, 1701 nt, Artificial Sequence
  derived and/or modified sequence opt3 from hemagglutinin__InfluenzaA__ADG59703
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuagccgcuauucuaagaaauuuaagccagagauugcaauccgacccaaagugcgugaucaggagggaagaaugaauuacuauuggacccugguggaaccuggugacaagauuacauucgaggccacuggcaaccuagucguuccaagguacgcuuuugccauggaacggaacgcaggguccggaaucgugauaagcgauaccccgguacaugacugcaauacaaccugucaaacgcccaaaggcgcuauuaacacuucgcucccuuuccagaauauccacccaauuacaaucgguaagugccccaaguaugugaaaucuaccaagcugcgccuugccacugggcugagaaacgucccuuccauccagucaaggggauuguuuggcgcgauugccggcuucauagaagggggauggacagguaugguggacggcugguacggguaucaucaccagaaugaacaaggaaguggcuacgcagcugaucucaaaagcacccagaacgccaucgacgagauuacgaauaagguuaacuccgugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauucuaauguuaaaaaccuguacgagaaggugcgaagccagcucaaaaacaaugcaaaggaaaucggcaacggauguuuugaguucuaucacaagugcgacaauacauguauggaaucagucaaaaacggcacuuacgauuauccaaaguacagugaggaagccaaacugaauagagaggagaucgacggggugaaacuugaauccaccaggauuuaucaaauccuggcuauuuacagcacagucgcgucuucauuggugcucguugugagucugggagcaauaaguuuuuggaugugcuccaacgguucuuuacagugccggaucuguauuuga

SEQ ID NO: 127000 - RNA, 1701 nt, Artificial Sequence; identical to SEQ ID NO: 124700
  derived and/or modified sequence opt3 from hemagglutinin__InfluenzaA__ADG76646

SEQ ID NO: 127001 - RNA, 1701 nt, Artificial Sequence
  derived and/or modified sequence opt3 from hemagglutinin__InfluenzaA__ADG76652
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccccaucgucagacaacggaacuugcuauccgggcgauuucaucgacuacgaagaguugagggagcagcucagcaguguguccucuuuugaacgguucgagauuuuucccaagacaagcuccuggccuaaucacgauucaaacaagggugucaccgcagccuguccacaugcuggggcaaaaaguuucuauaagaaucugaucuggcuggugaaaaagggaaacagcuaccccaaacucucuaaguccuauauaaaugacaagggcaaagaaguauuaguucuguggggcauccaccacccuucaacgagcgccgaucaacagagucuuuaccagaacgcugacacuuacguguuugucgggucuucccgcuauagcaagaaauucaagccagagauugccauccgacccaaagugcgugaucaggagggaagaaugaauuacuauuggaccuugguggaaccuggugacaagauuacauuugaggcgacuggcaaccuggucguuccaagguacgcauucgccauggaacggaacgcugggucgggaaucauaauuucugauaccccggugcaugacugcaauacaaccugucaaacgcccaaaggcgccaucaacacuucccuaccuuuucagaauauucacccaaucacaaucgguaagugccccaaguauguaaaaucaaccaagcuccgccuggcaacugggcuuagaaacauuccuaguauacagagcaggggacuguucggcgcuaucgccggcuuuauugaagggggauggacagguaugguggacggcugguacggguaucaucaccagaaugaacaaggauccggcuacgcggccgauuugaaaucuacccagaacgcaaucgacgagauaacgaauaaggucaacagcgugauugagaaaaugaauacccaguucacagcuguugguaaggaguucaaccaccucgagaagcggaucgaaaaucugaacaaaaagguggaugacggguuuuuagauaucuggacuuacaaugccgagcugcucguccuucuggaaaacgagcgcaccuuggacuaucaugauucaaaugugaaaaaccuauacgagaagguacgaagucagcugaaaaacaaugcuaaggaaauuggcaacggauguuucgaguuuuaucacaagugcgacaauacauguauggaauccguuaaaaacggcacuuacgauuauccaaaguacagcgaggaagccaaacucaauagagaggagaucgacggggugaagcuggaaucuaccaggauuuaucaaauacuugcaaucuacucaacagucgccaguagccugguguuggucgugucccucggagcuauuucuuucuggaugugcucgaacgguagccugcagugccggaucuguaucuga

SEQ ID NO: 127002 - RNA, 1701 nt, Artificial Sequence; identical to SEQ ID NO: 124927
  derived and/or modified sequence opt3 from hemagglutinin__InfluenzaA__ADH01808

SEQ ID NO: 127003 - RNA, 1701 nt, Artificial Sequence
  derived and/or modified sequence opt3 from hemagglutinin__InfluenzaA__ADH01818
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucaucgugagccugggagcaauuuccuuuuggaugugcucuaacgguucguuacagugccggaucuguaucuga

SEQ ID NO: 127004 - RNA, 1701 nt, Artificial Sequence; identical to SEQ ID NO: 124927
  derived and/or modified sequence opt3 from hemagglutinin__InfluenzaA__ADH01828

SEQ ID NO: 127005 - RNA, 1701 nt, Artificial Sequence; identical to SEQ ID NO: 124685
  derived and/or modified sequence opt3 from hemagglutinin__InfluenzaA__ADH01838

SEQ ID NO: 127006 - RNA, 1701 nt, Artificial Sequence; identical to SEQ ID NO: 124927
  derived and/or modified sequence opt3 from hemagglutinin__InfluenzaA__ADH01848

SEQ ID NO: 127007 - RNA, 1701 nt, Artificial Sequence; identical to SEQ ID NO: 124927
  derived and/or modified sequence opt3 from hemagglutinin__InfluenzaA__ADH01858

SEQ ID NO: 127008 - RNA, 1701 nt, Artificial Sequence; identical to SEQ ID NO: 124685
  derived and/or modified sequence opt3 from hemagglutinin__InfluenzaA__ADH01868

SEQ ID NO: 127009 - RNA, 1701 nt, Artificial Sequence; identical to SEQ ID NO: 124685
  derived and/or modified sequence opt3 from hemagglutinin__InfluenzaA__ADH01878

SEQ ID NO: 127010 - RNA, 1701 nt, Artificial Sequence; identical to SEQ ID NO: 124927
  derived and/or modified sequence opt3 from hemagglutinin__InfluenzaA__ADH01888

SEQ ID NO: 127011 - RNA, 1701 nt, Artificial Sequence; identical to SEQ ID NO: 124685
  derived and/or modified sequence opt3 from hemagglutinin__InfluenzaA__ADH01898

SEQ ID NO: 127012 - RNA, 1701 nt, Artificial Sequence; identical to SEQ ID NO: 124776
  derived and/or modified sequence opt3 from hemagglutinin__InfluenzaA__ADH01908

SEQ ID NO: 127013 - RNA, 1701 nt, Artificial Sequence
  derived and/or modified sequence opt3 from hemagglutinin__InfluenzaA__ADH01918
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagagaguagcugguccuacauuguugaaaccucuucgucagacaacggaacuugcuauccaggcgauuuuaucgacuacgaggagcucagggaacagcugagcaguguguccucuuucgagcgguuugaaauuuucccgaagacaagcuccuggcccaaucacgauucaaacaagggugucaccgcagccuguccucaugcuggggcaaaaaguuuuuauaagaaucugaucuggcucgugaaaaagggaaacagcuacccaaaauuaucuaaguccuauauaaaugacaaggagaaagagguacugguucuuuggggcauccaccaccccucaacgagcgccgaucaacagaguuuguaccagaacgcugacgccuacguguucgucggcacuucucgcuauuccaagaaauuuaagccugaaauugcgauccgaccaaaagugcgugaucaggaggggagaaugaauuacuauuggacccugguggaacccggagacaagauuacauucgaggcaacugguaaccuagucguuccuagguacgccuuugcuauggaacggaacgccggcagcgggaucauaauuucggauaccccagugcaugacugcaauacaaccugucaaacgccgaaaggagcaaucaacacuucucuccccuuccagaauauucacccuaucacaaucggcaagugcccaaaguauguaaaauccaccaagcugcgccuugcuacuggucugagaaacgugcccucaauucagaguaggggguuguuuggagccauagcgggcuucaucgagggcggguggacaggaauggucgacgguugguacggcuaucaucaccagaaugagcaagggagcggauacgccgcagaucucaaauccacccagaacgcuauugacaagaucacgaauaaagugaacucuguuauagaaaagaugaauacccaguuuacagccgugggcaaggaguucaaccaccuggaaaaacggauugagaauuuaaacaagaaagucgaugacgguuuccuggauaucuggacuuacaaugcugaacuccuugugcuguuggagaacgagcgcacccuagacuaucaugauagcaauguaaagaaccuguacgaaaaaguucgaucacagcucaagaacaaugccaaggagaucgggaacggcuguuuugaguucuaucacaaaugcgacaauacauguauggaaagugugaagaacggaacuuacgauuauccuaaauacuccgaagaggcaaagcugaauagagaggaaauugacggcgucaaacuugagagcaccaggaucuaucaaauucuggccauauacucuacaguggcuucaaguuugguccucgugguuagccugggggcgaucuccuuuuggaugugcucuaacggaucguuacagugccggauuuguaucuga

SEQ ID NO: 127014 - RNA, 1701 nt, Artificial Sequence
  derived and/or modified sequence opt3 from hemagglutinin__InfluenzaA__ADH01928
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcagugccuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacauucccucaauacagaguaggggauuguuuggcgccaucgcaggcuucauugaagggggauggacagguaugguagacggcugguacggguaucaucaccagaaugaacaaggaagcggcuacgcugccgaucucaaauccacccagaacgcuaucgacgagauaacgaauaaggugaacucugucauugagaaaaugaauacccaguuuacagccguggguaaggaguucaaccaccuggaaaagcggaucgaaaauuuaaacaaaaagguugaugacggguuccuggauaucuggacuuacaaugcagagcuccuugugcuguuggaaaacgagcgcacccuagacuaucaugauagcaaugucaaaaaccuguacgagaaggugcgaucacagcucaaaaacaaugccaaggaaauuggcaacggauguuuugaguucuaucacaagugcgacaauacauguauggaaaguguaaagaacggcacuuacgauuauccuaaguacuccgaggaagcuaaacugaauagagaggagaucgacgggguuaaacuugaaagcaccaggauuuaucaaauacuggcgaucuacucuacaguggcaucaaguuugguccucguggucagccugggagccauuuccuuuuggaugugcucuaacgguucguuacagugccggaucuguaucuga

SEQ ID NO: 127015 - RNA, 1701 nt, Artificial Sequence
  derived and/or modified sequence opt3 from hemagglutinin__InfluenzaA__ADH01938
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggagaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacaagaaaguacgaucacagcucaagaacaaugcaaaggagaucggcaacggauguuuugaguucuaucacaaaugcgacaauacauguauggagagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127016 - RNA, 1701 nt, Artificial Sequence; identical to SEQ ID NO: 125849
  derived and/or modified sequence opt3 from hemagglutinin__InfluenzaA__ADH01948

SEQ ID NO: 127017 - RNA, 1701 nt, Artificial Sequence
  derived and/or modified sequence opt3 from hemagglutinin__InfluenzaA__ADH01958
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaacugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguaaauucuguuauagagaaaaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaccuguacgagaagguucgaucacagcucaaaaauaacgcaaaggagaucggcaauggauguuuugaguucuaucacaagugcgacaacacauguauggaaagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucaucgugagccugggagcaauuuccuuuuggaugugcucuaaugguucguuacagugccggaucuguaucuga

SEQ ID NO: 127018 - RNA, 1701 nt, Artificial Sequence
  derived and/or modified sequence opt3 from hemagglutinin__InfluenzaA__ADH01968
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugauaagaucacgaauaaagugaacucuguuauagagaagaugaauacccaguuuacagcuguggguaaggaguucaaccaccuggagaaacggauugaaaauuuaaacaagaaagucgacgauggguuccuggacaucuggacuuacaaugccgagcuccuugugcuguuggaaaacgagcgcacccuagauuaucaugacagcaauguaaagaaccuguacgagaaaguucgaaaccagcucaagaauaacgcaaaggaaaucggcaauggauguuuugaguucuaucacaaaugcgauaacacauguauggaaucagugaagaauggcacuuacgacuauccuaaauacagugaggaagccaagcugaacagagaggagauugauggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 127019 - RNA, 1701 nt, Artificial Sequence; identical to SEQ ID NO: 125849
  derived and/or modified sequence opt3 from hemagglutinin__InfluenzaA__ADH01978

SEQ ID NO: 127020 - RNA, 1701 nt, Artificial Sequence; identical to SEQ ID NO: 125849
  derived and/or modified sequence opt3 from hemagglutinin__InfluenzaA__ADH01988

SEQ ID NO: 127021 - RNA, 1701 nt, Artificial Sequence; identical to SEQ ID NO: 126852
  derived and/or modified sequence opt3 from hemagglutinin__InfluenzaA__ADH01998

SEQ ID NO: 127022 - RNA, 1701 nt, Artificial Sequence
  derived and/or modified sequence opt3 from hemagglutinin__InfluenzaA__ADH02008
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucauaaagaagggcaacagcuacccaaaauuaucuaaguccuauaucaaugauaaggaaaaagaggugcugguacuuuggggcauucaccaccccucaacgagcgcugaccaacagaguuuguaccagaacgccgaugcguacguuuucguggggacuucucgcuauuccaagaaauuuaagccugagaucgcaauucgaccaaaaguccgugaccaggaaggaagaaugaauuacuauuggacccugguggagcccggugauaagaucacauucgaagccacuggcaaccuaguggucccuagguacgcuuuugccauggagcggaacgcagggagcggaauaauuaucucggacaccccaguucaugauugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacauacccucaauccagaguaggggauuguuuggcgcgauugccggcuucaucgaagggggauggacagguaugguagacggcugguacggguaucaucaccagaaugagcaaggaagcggcuacgcagcugaccucaaauccacccagaacgccauagaugagauuacgaauaaggugaacucugucaucgagaaaaugaauacccaguuuacagcuguggguaaggaguucaaccaccuggaaaagcggaucgagaauuuaaacaaaaagguugacgauggguuccuggacauuuggacuuacaaugccgaacuccuugugcuguuggagaacgagcgcacccuagauuaucaugacagcaaugucaaaaaccuguacgaaaaggugcgaucacagcucaaaaacaaugcaaaggagaucggcaacggauguuuugaguucuaucacaagugcgauaauacauguauggaaaguguuaaaaacggcacuuacgacuauccuaaguacuccgaagaggccaaacugaauagagaggaaauugaugggguaaaacuugagagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 127023 - RNA, 1701 nt, Artificial Sequence; identical to SEQ ID NO: 125849
  derived and/or modified sequence opt3 from hemagglutinin__InfluenzaA__ADI24508

SEQ ID NO: 127024 - RNA, 1701 nt, Artificial Sequence
  derived and/or modified sequence opt3 from hemagglutinin__InfluenzaA__ADI24515
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugccaacagcaucaaguuggagcuacaucguggagaccuccucuucggacaacggaacuugcuauccgggcgauuuuauugacuacgaggagcucagggagcagcugucaagcgucaguuccuucgaacgguuugagaucuuccccaagacaucuagcuggccuaaucacgauuccaacaagggugugaccgccgcuuguccacaugcaggggccaaaucauuuuauaagaaucugauuuggcucguuaaaaagggaaacaguuaccccaaauuaagcaagucuuauaucaaugacaagggcaaagaaguacuggugcuuuggggcauacaccacccuuccacgucagcugaucaacagagcuuguaccagaacgccgacgcguacgucuucguggggaccagucgcuauucuaagaaauuuaagccagagaucgcaauucgacccaaagugcgugaucaggagggaagaaugaauuacuauuggacucuggucgaaccuggugacaagaucacauucgaggccacuggcaaccuaguugugccaagguacgcuuuugccauggaacggaacgcaggguccggaauuaucauaagcgauaccccgguacaugacugcaauacaaccugucaaacgcccaaaggcgcuauuaacacuucgcucccuuuccagaauauccacccaauuacaaucgguaagugccccaaguaugugaaaucuaccaagcugcgccuugccacugggcugagaaacgucccuuccauccagucaaggggauuguuuggcgcgauugccggcuucauagaagggggauggacagguaugguggacggcugguacggguaucaucaccagaaugaacaaggaaguggcuacgcagcugaucucaaaagcacccagaacgccaucgacaaguccacgaauaaaguuaacucugugauugagaagaugaauacccaguuuacagcugucgguaaggaguucaaccaccuggaaaaacggaucgagaauuuaaacaagaaaguggaugacggguuccuggauauauggacuuacaaugccgaacuccuuguacuguuggagaacgaacgcacccuagacuaucaugauagcaauguuaagaaccuguacgagaaagugcgaucacagcucaagaacaaugcaaaggagauuggcaacggauguuuugaguucuaucacaaaugcgacaauacauguauggaaagugucaagaacggcacuuacgauuauccaaaauacuccgaagaggccaagcugaauagagaagagaucgacggggugaaacuugagagcaccaggaucuaucaaauucuggcuaucuacucuacagucgcgucaaguuuggugcucguugugagccugggagcaauuuccuuuuggaugugcucuaacgguucguuacagugccggauauguaucuga

SEQ ID NO: 127025 - RNA, 1701 nt, Artificial Sequence; identical to SEQ ID NO: 125849
  derived and/or modified sequence opt3 from hemagglutinin__InfluenzaA__ADI24517

SEQ ID NO: 127026 - RNA, 1701 nt, Artificial Sequence; identical to SEQ ID NO: 125849
  derived and/or modified sequence opt3 from hemagglutinin__InfluenzaA__ADI24519

SEQ ID NO: 127027 - RNA, 1701 nt, Artificial Sequence; identical to SEQ ID NO: 125849
  derived and/or modified sequence opt3 from hemagglutinin__InfluenzaA__ADI24521

SEQ ID NO: 127028 - RNA, 1701 nt, Artificial Sequence; identical to SEQ ID NO: 126237
  derived and/or modified sequence opt3 from hemagglutinin__InfluenzaA__ADI24523

SEQ ID NO: 127029 - RNA, 1701 nt, Artificial Sequence
  derived and/or modified sequence opt3 from hemagglutinin__InfluenzaA__ADI24525
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuaugugagcucagaggaguggcuccccugcaucuugguaagugcaacauagccggcuggauccuggggaauccugaaugugagucuuugucaacagcaaggaguuggagcuacauuguugaaaccuccucuucggacaacggaacuugcuauccaggcgauuuuaucgacuacgaggagcuccgggaacagcugucaagcgugaguuccuucgagcgcuuugaaauuuucccgaaaacaucuagcuggcccaaucacgauuccaacaagggugucaccgccgcuuguccucaugcaggggccaagucauuuuauaaaaaucugaucuggcucgugaagaaaggaaacaguuacccaaaguuaagcaaaucuuauauaaaugacaagggcaaggagguacugguucuuuggggcauccaccaccccuccacgucagcugaucaacagagcuuguaccagaacgccgacgcguacguguucgucgggaccagucgauauucuaaaaaguuuaaaccugagauugcaauccguccaaaggugagagaucaggaaggaaggaugaauuacuauuggacucugguggagcccggugacaaaauuacauucgaagccacuggcaaccuagucguuccucgguacgcuuuugccauggagcgcaacgcaggguccggaaucauaauuagcgauaccccagugcaugacugcaauacaaccugucaaacgccgaagggcgcuaucaacacuucgcuccccuuccagaauauucacccuaucacaaucgguaaaugcccaaaguauguaaagucuaccaaacugagacuugccacugggcugaggaacgugcccuccauucagucacggggauuguuuggcgcgauagccggcuucaucgaagggggauggacagguauggucgacggcugguacggguaucaucaccagaaugagcaaggaaguggcuacgcagcugaucucaagagcacccagaacgccauugacaaaaucacgaauaaggugaacuccguuauagagaaaaugaauacccaguuuacagcuguggguaaggaguucaaccaccuggaaaagcgcauugaaaauuuaaacaaaaaggucgaugacggguuccuggauaucuggacuuacaaugccgagcuccuugugcuguuggaaaacgagcgaacccuagacuaucaugauucuaauguuaaaaaccuguacgagaagguaaaaagccagcucaagaacaaugcaaaggaaaucggcaacggauguuuugaguucuaucacaaaugcgacaauacauguauggaaucagugaagaacggcacuuacgauuauccuaaauacagugaggaagccaagcugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 127030 - RNA, 1701 nt, Artificial Sequence; identical to SEQ ID NO: 125849
  derived and/or modified sequence opt3 from hemagglutinin__InfluenzaA__ADI24527

SEQ ID NO: 127031 - RNA, 1701 nt, Artificial Sequence; identical to SEQ ID NO: 126237
  derived and/or modified sequence opt3 from hemagglutinin__InfluenzaA__ADI24529

SEQ ID NO: 127032 - RNA, 1701 nt, Artificial Sequence
  derived and/or modified sequence opt3 from hemagglutinin__InfluenzaA__ADI24531
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauugcucggcgcgauagccggcuuuaucgaagggggauggacagguauggucgacggcugguacggguaucaucaccagaacgaacaaggaagcggcuacgcagcugaccugaaauccacccagaaugccauugauaagaucacgaacaaaguuaauucugugauagagaagaugaacacccaguucacagcuguggguaaggaguuuaaucacuuagaaaaacggauugagaaccugaauaagaaagucgacgauggguuccucgacaucuggacuuacaacgccgaacuucugguguugcuagagaaugaacgcacccuggauuaucaugacagcaacguaaagaaccucuacgagaaaguucgaucacagcugaagaauaacgcaaaggagaucggcaauggauguuucgaauuuuaucacaaaugcgauaacacauguauggagagugugaagaauggcacuuacgacuauccuaaauacuccgaagaggccaaacuuaacagagaagagauugauggggucaagcuggagagcaccaggaucuaucaaauuuuggcuauauacucuacaguggcgucaagucucguccuggugguuagcuuaggagcaaucuccuucuggaugugcucuaaugguucgcugcagugcaagauuuguaucuga

SEQ ID NO: 127033 - RNA, 1701 nt, Artificial Sequence
  derived and/or modified sequence opt3 from hemagglutinin__InfluenzaA__ADI24536
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacgggaugcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaaaucgacgauggguuccuggacaucuggacuuacaacgccgaacuccuuguccuguuggagaaugaacgcacccuagauuaucaugacagcaacgugaagaaucuguacgagaaaguacgaucacagcucaagaacaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127034 - RNA, 1701 nt, Artificial Sequence; identical to SEQ ID NO: 125849
  derived and/or modified sequence opt3 from hemagglutinin__InfluenzaA__ADI24546

SEQ ID NO: 127035 - RNA, 1701 nt, Artificial Sequence; identical to SEQ ID NO: 125849
  derived and/or modified sequence opt3 from hemagglutinin__InfluenzaA__ADI24553

SEQ ID NO: 127036 - RNA, 1701 nt, Artificial Sequence; identical to SEQ ID NO: 125849
  derived and/or modified sequence opt3 from hemagglutinin__InfluenzaA__ADI24555

SEQ ID NO: 127037 - RNA, 1701 nt, Artificial Sequence
  derived and/or modified sequence opt3 from hemagglutinin__InfluenzaA__ADI24557
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaauccugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 127038 - RNA, 1701 nt, Artificial Sequence; identical to SEQ ID NO: 125849
  derived and/or modified sequence opt3 from hemagglutinin__InfluenzaA__ADI24559

SEQ ID NO: 127039 - RNA, 1701 nt, Artificial Sequence
  derived and/or modified sequence opt3 from hemagglutinin__InfluenzaA__ADI24561
augaaggccauccuggugauucuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacgacgggaaacuauguaagcucagaggagucgcuccccugcaucuugguaaaugcaauaucgccggcuggauucuggggaacccugagugugaaucuuugucaacagcaaguagcugguccuacaucguggagaccucuucgucagauaauggaacuugcuauccaggcgacuuuauugauuacgaggagcucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaacgagcgcugaccaacagaguuuguaccagaaugccgaugcguacguuuucguggggacuucucgcuauuccaagaaauuuaagccugagaucgcaauucgaccaaaaguccgugaccaggagggaagaaugaacuacuauuggacccugguggaacccggugauaagaucacauucgaggccacuggcaaucuaguggucccuagguacgcuuuugccauggaacggaacgcagggagcggaauaauuaucucggacaccccaguucaugacugcaacacaaccugucaaacgccgaaaggcgcuauuaauacuucucuccccuuccagaacauccacccuaucacaauugguaagugcccaaaguaugugaaauccaccaagcugcgccuugccacugggcugagaaauguacccucaauacagaguaggggauuguuuggcgcgaucgccggcuucauugaagggggauggacagguaugguggauggcugguacggguaucaucaccagaacgaacaaggaagcggcuacgcagcugaccucaaauccacccagaaugccaucgauaagauaacgaacaaagucaauucugugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaucuguacgagaaaguacgaucacagcucaagaacaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127040 - RNA, 1701 nt, Artificial Sequence; identical to SEQ ID NO: 125849
  derived and/or modified sequence opt3 from hemagglutinin__InfluenzaA__ADI24563

SEQ ID NO: 127041 - RNA, 1701 nt, Artificial Sequence
  derived and/or modified sequence opt3 from hemagglutinin__InfluenzaA__ADI24565
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaaaagguacugguucuuuggggcauccaccaccccucaacgagcgcugaccaacagaguuuguaccagaaugccgaugcguacguguucgucgggacuucucgcuauuccaaaaaguuuaaaccugaaauugcaauccgaccaaaggugcgugaccaggagggaagaaugaacuacuauuggacccugguggagcccggugauaaaauuacauucgaagccacuggcaaucuagucguuccuagguacgcuuuugccauggagcggaacgcagggagcggaaucauaauuucggacaccccagugcaugacugcaacacaaccugucaaacgccgaagggcgcuaucaauacuucucuccccuuccagaacauucacccuaucacaaucgguaagugcccaaaauauguaaaguccaccaaacugcgccuugccacugggcugagaaaugugcccucaauucagaguaggggauuguuuggcgcgauagccggcuucaucgaagggggauggacagguauggucgauggcugguacggguaucaucaccagaacgagcaaggaagcggcuacgcagcugaccucaaguccacccagaaugccauugauaaaaucacgaacaagguaaauucuguuauagaaaagaugaacacccaguuuacagcuguggguaaagaguucaaucaccuggagaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgaaaagguucgaucacagcucaagaacaacgcaaaagagaucggcaauggauguuuugaguucuaucacaagugcgauaacacauguauggaaagugugaaaaauggcacuuacgacuauccuaaguacuccgaggaagccaaacugaacagagaggaaauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127042 - RNA, 1701 nt, Artificial Sequence; identical to SEQ ID NO: 125849
  derived and/or modified sequence opt3 from hemagglutinin__InfluenzaA__ADI24567

SEQ ID NO: 127043 - RNA, 1701 nt, Artificial Sequence
  derived and/or modified sequence opt3 from hemagglutinin__InfluenzaA__ADI24569
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccaucgaacggaacgcagggagcggaauaauuaucucggauaccccagugcaugacugcaauacaaccugucaaacgccgaaaggcgcuauuaacacuucucuccccuuccagaauauccacccuaucacaauugguaagugcccaaaguauguaaaauccaccaagcugcgccuugccacugggcugagaaacgugcccucaauacagaguaggggauuguuuggcgcgaucgccggcuucauugaagggggauggacagguauggucgacggcugguacggguaucaucaccagaaugaacaaggaagcggcuacgcagcugaucucaaauccacccagaacgccaucgacaagauaacgaauaaagugaacucuguuauugagaagaugaauacccaguuuacagcuguggguaaggaguucaaccaccuggaaaaacggaucgagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagauuggcaacggauguuuugaguucuaucacaaaugcgacaauacauguauggaaagugugaagaacggcacuuacgauuauccuaaauacuccgaagaggccaagcugaauagagaagagaucgacggggucaaacuugagagcaccaggauuuaucaaauacuggcuaucuacucuacaguggcgucaaguuugguccucgugguuagccugggagcaauuuccuuuuggaugugcucuaacgguucguuacagugccggaucuguaucuga

SEQ ID NO: 127044 - RNA, 1701 nt, Artificial Sequence; identical to SEQ ID NO: 125849
  derived and/or modified sequence opt3 from hemagglutinin__InfluenzaA__ADI24571

SEQ ID NO: 127045 - RNA, 1701 nt, Artificial Sequence; identical to SEQ ID NO: 126237
  derived and/or modified sequence opt3 from hemagglutinin__InfluenzaA__ADI24573

SEQ ID NO: 127046 - RNA, 1701 nt, Artificial Sequence
  derived and/or modified sequence opt3 from hemagglutinin__InfluenzaA__ADI24575
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguagagaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127047 - RNA, 1701 nt, Artificial Sequence; identical to SEQ ID NO: 125849
  derived and/or modified sequence opt3 from hemagglutinin__InfluenzaA__ADI24577

SEQ ID NO: 127048 - RNA, 1701 nt, Artificial Sequence
  derived and/or modified sequence opt3 from hemagglutinin__InfluenzaA__ADI24581
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggguucuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguuaaaaagggaaacagcuacccaaaauuaucuaaguccuauaucaaugacaagggcaaagaaguacuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacaagauuacgaauaaaguuaacucugugaucgagaagaugaauacccaguuuacagcugucgguaaggaguucaaccaccuggaaaaacggauagagaauuuaaacaagaaaguggaugacggguuccuggauauuuggacuuacaaugccgaacuccuuguacuguuggagaacgaacgcacccuagacuaucaugauagcaauguuaagaaccuguacgagaaagugcgaucacagcucaagaacaaugcaaaggagaucggcaacggauguuuugaguucuaucacaaaugcgacaauacauguauggaaagugucaagaacggcacuuacgauuauccuaaauacuccgaagaggccaagcugaauagagaagagaucgacggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 127049 - RNA, 1701 nt, Artificial Sequence
  derived and/or modified sequence opt3 from hemagglutinin__InfluenzaA__ADI24583
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 127050 - RNA, 1701 nt, Artificial Sequence
  derived and/or modified sequence opt3 from hemagglutinin__InfluenzaA__ADI24590
augaaggccauccuggugguccuccuuuacaccuucgcuacagcaaacgccgacacucugugcauuggcuaucacgcgaauaacagcacggauaccguugacacaguguuggagaaaaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 127051 - RNA, 1701 nt, Artificial Sequence
  derived and/or modified sequence opt3 from hemagglutinin__InfluenzaA__ADI24597
augaaggccauccuggugguccuccuuuacaccuucgcuacagcaaacgccgacacucugugcauuggcuaucacgcgaauaacagcacggauaccguugacacaguguuggagaagaauguaacugugacccauuccgcuaacuuacuggaagauaagcacaaugggaaacuauguaagcucagaggagucgcaccccugcaucuugguaacugcaauauagccggcuggauccuggggaacccugagugugaaucuuugucaacagccaguagcugguccuacauuguggagaccucuucgucagacaauggaacuugcuauccaggcgauuuuaucgacuacgaggagcucagggagcagcugagcaguguuuccucuuucgaacgguuugagauuuucccgaaaacaagcuccuggcccaaccacgauucaaauaagggugugaccgcugcauguccucaugccggggcuaagaguuuuuauaaaaaccugaucuggcucgucaagaaaggaaauagcuacccaaaguuaucuaaauccuauauaaacgacaagggcaaggaagugcugguacuuuggggcauccaccaccccucaacgagcgccgaucaacagaguuuguaccagaaugcggacgcauacguuuucguggggacuucucgcuauuccaaaaaguuuaaaccugagauugccauccgaccaaagguccgugaucaggagggaagaaugaacuacuauuggacccugguggaacccggugacaaaauuacauucgaggcuacuggcaaccuaguggucccuagguacgccuuugcaauggaacggaaugcugggagcggaaucauaauuucggauaccccaguucaugacugcaacacaaccugucaaacgccgaagggcgccaucaauacuucucuccccuuccagaacauucacccuaucacaaucgguaaaugcccaaaguaugugaaguccaccaaacugcgccuugcgacugggcugagaaauguacccucaauucagaguaggggauuguuuggcgccauagcaggcuucaucgaagggggauggacagguaugguggacggcugguacggguaucaucaccagaacgaacaaggaagcggcuacgcugccgaucucaaguccacccagaaugcuauugacaaaaucacgaacaaggucaauucugugauagagaaaaugaacacccaguuuacagccguugguaaggaguucaaucaccuggaaaagcggauugagaacuuaaauaaaaagguggaugacggguuccuggauaucuggacuuacaacgcagaacuccuuguccuguuggagaaugaacgcacccuagacuaucaugauagcaacgugaaaaaccuguacgagaagguacgaucacagcucaaaaauaacgccaaggagaucggcaauggauguuuugaguucuaucacaagugcgacaacacauguauggaaaguguuaaaaauggcacuuacgauuauccuaaguacuccgaagaggcuaaacugaacagagaagagauugacggggugaaacuugagagcaccaggaucuaucaaauucuggcgauauacucuacagucgcaucaaguuuggugcucgucgugagccugggagccaucuccuuuuggaugugcucuaaugguucguuacagugccggauuuguaucuga

SEQ ID NO: 127052 - RNA, 1701 nt, Artificial Sequence; identical to SEQ ID NO: 127050
  derived and/or modified sequence opt3 from hemagglutinin__InfluenzaA__ADI24612

SEQ ID NO: 127053 - RNA, 1701 nt, Artificial Sequence
  derived and/or modified sequence opt3 from hemagglutinin__InfluenzaA__ADI24619
augaaggccauccuggugguccuccuuuacaccuucgcuacagcaaacgccgacacucugugcauuggcuaucacgcgaauaacagcacggauaccguugacacaguguuggagaaaaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcguugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127054 - RNA, 1701 nt, Artificial Sequence
  derived and/or modified sequence opt3 from hemagglutinin__InfluenzaA__ADI24621
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcacuaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucaucgugagccugggagcgauuuccuuuuggaugugcucuaacgguucguuacagugccggaucuguaucuga

SEQ ID NO: 127055 - RNA, 1701 nt, Artificial Sequence
  derived and/or modified sequence opt3 from hemagglutinin__InfluenzaA__ADI48184
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggggcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacaagaucacgaauaaagugaacucuguuauagaaaagaugaauacccaguuuacagcuguggggaaggaguucaaccaccuggagaaacggauugaaaauuuaaacaagaaagucgaugacggcuuccuggauaucuggacuuacaaugccgagcuccuugugcuguuggaaaacgagcgcacccuagacuaucaugauagcaauguaaagaaccuguacgaacgaguuagaucacagcucaaaaacaaugcaaaggagaucggaaacggcuguuuugaguucuaucacaagugcgacaauacauguauggaaagugugaaaaacgggacuuacgauuauccuaaguacuccgaggaagccaaacugaauagggaggaaauugacggagucaaacuugagagcacccggaucuaucaaauucuggcuauauacucuacaguggcgucaaguuugguccucgugguuagccugggugcaaucuccuuuuggaugugcucuaacggcucguuacagugccguauuuguaucuga

SEQ ID NO: 127056 - RNA, 1701 nt, Artificial Sequence; identical to SEQ ID NO: 125849
  derived and/or modified sequence opt3 from hemagglutinin__InfluenzaA__ADI48186

SEQ ID NO: 127057 - RNA, 1701 nt, Artificial Sequence
  derived and/or modified sequence opt3 from hemagglutinin__InfluenzaA__ADI48188
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcgauaucauaauuucggacaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgagggcggguggacaggaauggucgaugguugguacggcuaucaucaccagaaugaacaagggagcggauacgcagcugaccucaaauccacccagaacgccauugauaagaucacgaauaaagugaacucuguuauagagaagaugaauacccaguuuacagcugugggcaaggaguucaaccaccuggaaaaacggauugagaauuuaaacaagaaagucgacgaugguuuccuggacaucuggacuuacaaugccgaacuccuugugcuguuggagaacgaacgcacccuagauuaucaugacagcaauguaaagaaccuguacgagaaaguucgaucacagcucaagaacaaugcaaaggagaucgggaacggcuguuuugaguucuaucacaaaugcgauaauacauguauggagagugugaagaacggaacuuacgacuauccuaaauacuccgaagaggccaagcugaauagagaagagauugauggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 127058 - RNA, 1701 nt, Artificial Sequence
  derived and/or modified sequence opt3 from hemagglutinin__InfluenzaA__ADI48190
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaagaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 127059 - RNA, 1701 nt, Artificial Sequence
  derived and/or modified sequence opt3 from hemagglutinin__InfluenzaA__ADI48192
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucugacaauauacucuaccguggcuucaaguuugguccucgugguuagccugggagcgaucuccuuuuggaugugcucuaacgguucguuacagugccggauuuguaucuga

SEQ ID NO: 127060 - RNA, 1701 nt, Artificial Sequence
  derived and/or modified sequence opt3 from hemagglutinin__InfluenzaA__ADI48194
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagccuggugaguuccuucgaacgguuugagauuuucccgaagacaaauucuuggcccaaccacgauagcaauaagggugucaccgccgcuuguccucaugcaggggccaaauccuuuuauaagaaccucaucugguuagugaaaaagggaaauucauacccaaaacugaguaagagcuauauaaacgacaagggcaaagaaguacuuguuuuguggggcauccaccaccccucuacguccgcugaucaacagucacuguaccagaaugccgacgcguacguguucgucgggacuagccgcuauaguaagaaauuuaagccugagauugcaauccgaccaaaagugcgugaucaggagggaagaaugaacuacuauuggacccuaguggaacccggugacaagauuacauucgaggccacuggcaaccucgucguuccuagguacgcuuuugccauggaacggaaugcagggucuggaaucauaauuuccgauaccccagugcaugacugcaacacaaccugucaaacgccgaaaggcgcuaucaauacuagccugcccuuccagaacauucacccuaucacaaucgguaagugcccaaaguauguaaaaucgaccaaacuucgccuggccacuggguugagaaaugugcccucuauucaguccaggggacucuuuggcgcgauagccggcuucaucgaagggggauggacagguauggucgacggcugguacggguaucaucaccagaacgaacaaggaucaggcuacgcagcugaucugaagaguacccagaaugccauugacaagaucacgaacaaagugaauagcguuauagagaagaugaacacccaguuuacagcuguggguaaggaguucaaucacuuagaaaaacggauugagaaccugaauaagaaagucgaugacggguuccucgauaucuggacuuacaacgccgaacuucugguguugcuagagaaugaacgcacccuggacuaucaugauuccaacguaaagaaccucuacgagaaaguucgaucucagcugaagaauaacgcaaaggagaucggcaauggauguuuugaguucuaucacaaaugcgacaacacauguauggaaagcgugaagaauggcacuuacgauuauccuaaauacucagaagaggccaaacuuaacagagaagagauugacggggucaagcuggagaguaccaggaucuaucaaauuuuggcuauauacuccacaguggcgagcucucucguccuggugguuucauuaggagcaaucaguuuuuggaugugcagcaaugguucccugcagugccggauuuguaucuga

SEQ ID NO: 127061 - RNA, 1701 nt, Artificial Sequence
  derived and/or modified sequence opt3 from hemagglutinin__InfluenzaA__ADI48196
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugauagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127062 - RNA, 1701 nt, Artificial Sequence; identical to SEQ ID NO: 125849
  derived and/or modified sequence opt3 from hemagglutinin__InfluenzaA__ADI48198

SEQ ID NO: 127063 - RNA, 1701 nt, Artificial Sequence; identical to SEQ ID NO: 125849
  derived and/or modified sequence opt3 from hemagglutinin__InfluenzaA__ADI48200

SEQ ID NO: 127064 - RNA, 1701 nt, Artificial Sequence
  derived and/or modified sequence opt3 from hemagglutinin__InfluenzaA__ADI48202
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagaucagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacaagauaaccaauaaagugaacucuguuauugagaagaugaauacgcaguuuaccgcuguggguaaggaguucaaccaccuggaaaaacggaucgagaauuuaaacaagaaagucgaugacggguuccuggauaucuggacauacaaugccgaacuccuugugcuguuggagaacgaacgcacucuagacuaucaugauagcaauguaaagaaccuguacgagaaaguucgaucacagcucaagaacaaugcaaaggagauuggcaacggauguuuugaguucuaucacaaaugcgacaauaccuguauggaaagugugaagaacggcacauacgauuauccuaaauacuccgaagaggccaagcugaauagagaagagaucgacggggucaaacuugagagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 127065 - RNA, 1701 nt, Artificial Sequence
  derived and/or modified sequence opt3 from hemagglutinin__InfluenzaA__ADI48204
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacguggacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacaagaucacgaaaaagguuaauucugugauagagaagaugaacacccaguuuacagccgucgguaaagaguucaaucaccuggaaaagcggauugagaacuuaaauaaaaagguggaugacggguuccuggauaucuggacuuacaacgcugaacuccuuguacuguuggagaaugaacgcacccuagacuaucaugauagcaacguuaaaaaucuguacgagaaggugcgaucacagcucaagaacaacgccaaagagaucggcaauggauguuuugaguucuaucacaagugcgacaacacauguauggaaagugucaaaaauggcacuuacgauuauccuaaguacuccgaagaggcaaaacugaacagagaagagauugacggggugaaacuugagagcaccaggaucuaucaaauucuggccauauacucuacagucgcuucaaguuuggugcucguugugagccugggagcgaucuccuuuuggaugugcucuaaugguucguuacagugccggauuuguaucuga

SEQ ID NO: 127066 - RNA, 1701 nt, Artificial Sequence; identical to SEQ ID NO: 125849
  derived and/or modified sequence opt3 from hemagglutinin__InfluenzaA__ADI48208

SEQ ID NO: 127067 - RNA, 1701 nt, Artificial Sequence; identical to SEQ ID NO: 125849
  derived and/or modified sequence opt3 from hemagglutinin__InfluenzaA__ADI48210

SEQ ID NO: 127068 - RNA, 1701 nt, Artificial Sequence
  derived and/or modified sequence opt3 from hemagglutinin__InfluenzaA__ADI48212
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauguguggacuuacaaugccgaacuccuuguacuguuggagaacgaacgcacccuagacuaucaugauagcaauguuaagaaccuguacgagaaagugcgaucacagcucaagaacaaugcaaaggagaucggcaacggauguuuugaguucuaucacaaaugcgacaauacauguauggaaagugucaagaacggcacuuacgauuauccuaaauacuccgaagaggccaagcugaauagagaagagaucgacggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 127069 - RNA, 1701 nt, Artificial Sequence
  derived and/or modified sequence opt3 from hemagglutinin__InfluenzaA__ADI48214
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacaagauaaccaauaaagugaacucuguuauugagaagaugaauacgcaguuuaccgcuguggguaaggaguucaaccaccuggaaaaacggaucgagaauuuaaacaagaaagucgaugacggguuccuggauaucuggacauacaaugccgaacuccuugugcuguuggagaacgaacgcacucuagacuaucaugauagcaauguaaagaaccuguacgagaaaguucgaucacagcucaagaacaaugcaaaggagauuggcaacggauguuuugaguucuaucacaaaugcgacaauaccuguauggaaagugugaagaacggcacauacgauuauccuaaauacuccgaagaggccaagcugaauagagaagagaucgacggggucaaacuugagagcacuaggauuuaucaaauacuggcuaucuacucuaccguggcgucaaguuugguccucgcagugagccugggagccauuuccuuuuggaugugcucuaacgguucguuacagugccggaucuguaucuga

SEQ ID NO: 127070 - RNA, 1701 nt, Artificial Sequence; identical to SEQ ID NO: 127068
  derived and/or modified sequence opt3 from hemagglutinin__InfluenzaA__ADI48216

SEQ ID NO: 127071 - RNA, 1701 nt, Artificial Sequence
  derived and/or modified sequence opt3 from hemagglutinin__InfluenzaA__ADI48218
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaggauagcaauguaaagaaccuguacgagaaaguucgaucacaacucaagaacaaugcaaaggagaucggcaacggauguuuugaguucuaucauaaaugcgacaauacauguauggaaagugugaagaacggcacuuacgauuauccuaaauacuccgaagaggccaagcugaauagagaagagauugacggggucaaacuugagagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 127072 - RNA, 1701 nt, Artificial Sequence
  derived and/or modified sequence opt3 from hemagglutinin__InfluenzaA__ADI48220
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgagacuaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuaggcuaucaugacagcaauguaaagaaccuguacgagaaaguucgaucacagcucaagaacaaugccaaggagaucggaaacggcuguuuugaguucuaucacaaaugcgauaauacuuguauggaaagugugaagaacgggaccuacgacuauccuaaauacuccgaagaggcaaagcugaauagagaagagauugauggagucaaacuugagagcacaaggaucuaucaaauucuggccauauacucuaccguggcuucaaguuugguccucgugguuagccugggugcgaucuccuuuuggaugugcucuaacggcucguuacagugccggauuuguaucuga

SEQ ID NO: 127073 - RNA, 1701 nt, Artificial Sequence
  derived and/or modified sequence opt3 from hemagglutinin__InfluenzaA__ADI48622
augaaggccauccugguguuccuccuuuacaccuuugcuacagcaaacgccgacacucugugcauuggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacauagccggcuggauccuggggaauccugagugugaaucuuugucaacagcaaguagcugguccuacauuguggagaccucuucgucagacaacggaacuugcuauccaggcgauuucaucgacuacgaggagcucagggagcagcugagcaguguuuccucuuuugaacgguucgagauuuuuccgaagacaagcuccuggcccaaucacgauucaaacaagggugugaccgccgcuuguccucaugcaggggccaaaaguuucuauaagaaucugaucuggcucgucaaaaagggaaacagcuacccaaaauuaucuaaguccuauauaaaugacaagggcaaagaagugcugguacuuuggggcauccaccaccccucaacgagcgcugaucaacagaguuuguaccagaacgccgacgcguacguuuuuguggggacuucucgcuauuccaagaaauucaagccugagauugcaauccgaccaaaaguccgugaucaggagggaagaaugaauuacuauuggacccugguggaacccggugacaagauuacauuugaggccacuggcaaccuaguggucccuagguacgcuuucgccauggaacggaacgcagggagcggaaucauaauuucggauaccccaguucaugacugcaauacaaccugucaaacgccgaaaggcgcuaucaacacuucucuccccuuucagaauauucacccuaucacaaucgguaagugcccaaaguaugugaaauccaccaagcugcgccuugccacugggcugagaaacguacccucaauucagaguaggggauuguucggcgcgauagccggcuuuaucgaagggggauggacagguaugguggacggcugguacggguaucaucaccagaaugaacaaggaagcggcuacgcagcugaucucaaauccacccagaacgccauugacgagaucacgaauaaggucaacucugugauagagaaaaugaauacccaguucacagcuguugguaaggaguucaaccaccuggaaaagcggauugaaaauuuaaacaaaaagguggaugacggguuucuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaaucggcaacggauguuucgaguuuuaucacaagugcgacaauacauguauggaaaguguuaaaaacggcacuuacgauuauccuaaguacuccgaggaagccaaacugaauagagaggagauugacggggugaaacuugaaagcaccaggaucuaucaaauucuggcuauauacucuacagucgcgucaaguuuggugcucgucgugagccugggagcaaucuccuucuggaugugcucuaacgguucguuacagugccggauuuguaucuga

SEQ ID NO: 127074 - RNA, 1701 nt, Artificial Sequence
  derived and/or modified sequence opt3 from hemagglutinin__InfluenzaA__ADI48632
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcgugcaccaccccucaacgagcgcugaucaacagaguuuguaccagaacgccgacgcguacgucuucguggggucuucccgcuauagcaaaaaguuuaaaccugagaucgcaauucgaccaaaggugcgugaucaggaaggaagaaugaauuacuauuggacucuggucgagcccggugacaaaaucaccuucgaagccacaggcaaccuaguugugccuagguacgcuuuugccauggagcggaacgcagggucgggaauuaucauaucugauacuccaguacaugacugcaauaccacaugucaaaccccgaagggcgcuauuaacacgucccuccccuuccacaauauccauccuauuacuaucgguaaaugcccaaaguaugugaagucaacaaaacugcgccuugccaccgggcugagaaacguccccaguauccagagcaggggauuguuuggcgcgauugccggcuucauagaagggggauggacugguaugguggacggcugguacggguaucaccaccagaaugagcagggauccggcuacgcagcugaucucaagucuacacaaaacgccaucgacgagauuaccaauaaaguuaacagcgugaucgaaaagaugaauacgcaguuuaccgcugucgguaaagaguucaaccaucuggaaaagcggauagagaauuuaaacaagaaaguggaugacggguuccuggauauuuggacauacaaugccgaacuccuuguacuguuggagaacgagcgcacucuagacuaucacgauucaaauguuaagaaccuguacgaaaaagugcgaagucagcucaagaacaaugcaaaagagaucggcaacggauguuuugaguucuaucauaagugcgacaauaccuguauggaauccgucaagaacggcacauacgauuauccuaaauacagcgaagaggccaagcugaauagagaggaaaucgacggggugaaacuugagucuacuaggauuuaucagauccuggcuauuuacucaaccgucgcgaguagcuuggugcucguugugucccugggagcaauaucuuuuuggaugugcucgaacgguagcuuacaaugccggaucuguauuuga

SEQ ID NO: 127075 - RNA, 1701 nt, Artificial Sequence; identical to SEQ ID NO: 124927
  derived and/or modified sequence opt3 from hemagglutinin__InfluenzaA__ADI48642

SEQ ID NO: 127076 - RNA, 1701 nt, Artificial Sequence; identical to SEQ ID NO: 124927
  derived and/or modified sequence opt3 from hemagglutinin__InfluenzaA__ADI48652

SEQ ID NO: 127077 - RNA, 1701 nt, Artificial Sequence
  derived and/or modified sequence opt3 from hemagglutinin__InfluenzaA__ADI48672
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaauaaccugaucuggcucgugaaaaagggaaauagcuacccaaaauuaucuaaguccuauauaaacgacaaaggcaaggagguacugguucuuuggggcauccaccaccccucaacgagcgcugaucaacagaguuuguaccagaaugccgacgcguacguguucgucgggucuucccgcuauagcaagaaauuuaagccugagauugcaauccgaccaaaagugcgugaucaggaaggaagaaugaacuacuauuggacucugguggagcccggugacaagauuaccuucgaagccacaggcaaccuagucguuccuagguacgcuuuugccauggagcggaaugcagggucgggaaucauaauuucugauacuccagugcaugacugcaacaccacaugucaaaccccgaaaggcgcuaucaauacgucccuccccuuccacaacauucauccuaucacuaucgguaagugcccaaaauauguaaagucaacaaagcugcgccuugccaccgggcugagaaaugugcccaguauucagagcaggggauuguuuggcgcgauagccggcuucaucgaagggggauggacugguauggucgacggcugguacggguaucaccaccagaacgagcagggauccggcuacgcagcugaucucaaaucuacacaaaaugccauugacgagaucaccaacaaggugaauagcguuauagaaaagaugaacacgcaguuuaccgcuguggguaaggaguucaaucaucuggaaaaacggauugagaacuuaaauaagaaggucgaugacggguuccuggauaucuggacauacaacgccgaacuccuugugcuguuggagaaugagcgcacucuagacuaucacgauucaaacguuaaaaaccuguacgaaaagguacgaagucagcucaaaaauaacgcaaaggagaucggcaauggauguuuugaguucuaucauaaaugcgacaacaccuguauggaauccgugaagaauggcacauacgauuauccuaaguacagcgaagaggccaaacugaacagagaggaaauugacggggucaaacuugagucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 127078 - RNA, 1701 nt, Artificial Sequence; identical to SEQ ID NO: 124685
  derived and/or modified sequence opt3 from hemagglutinin__InfluenzaA__ADI48682

SEQ ID NO: 127079 - RNA, 1701 nt, Artificial Sequence; identical to SEQ ID NO: 124927
  derived and/or modified sequence opt3 from hemagglutinin__InfluenzaA__ADI48692

SEQ ID NO: 127080 - RNA, 1701 nt, Artificial Sequence; identical to SEQ ID NO: 124865
  derived and/or modified sequence opt3 from hemagglutinin__InfluenzaA__ADI48702

SEQ ID NO: 127081 - RNA, 1701 nt, Artificial Sequence; identical to SEQ ID NO: 124927
  derived and/or modified sequence opt3 from hemagglutinin__InfluenzaA__ADI48712

SEQ ID NO: 127082 - RNA, 1701 nt, Artificial Sequence; identical to SEQ ID NO: 124927
  derived and/or modified sequence opt3 from hemagglutinin__InfluenzaA__ADI48722

SEQ ID NO: 127083 - RNA, 1701 nt, Artificial Sequence; identical to SEQ ID NO: 124685
  derived and/or modified sequence opt3 from hemagglutinin__InfluenzaA__ADI48732

SEQ ID NO: 127084 - RNA, 1701 nt, Artificial Sequence; identical to SEQ ID NO: 124685
  derived and/or modified sequence opt3 from hemagglutinin__InfluenzaA__ADI48742

SEQ ID NO: 127085 - RNA, 1701 nt, Artificial Sequence
  derived and/or modified sequence opt3 from hemagglutinin__InfluenzaA__ADI48752
auggaggccauccugguguuccuccuuuacaccuuugcuacagcaaacgccgacacucugugcauuggcuaucacgcgaauaacagcacggauaccgucgacacaguuuuggaaaagaaugugacuguaacccauuccgugaacuuacuggaggauaaacacaaugggaagcuauguaaacucagaggagucgcuccccugcaucuugguaagugcaacauagccggcuggauccuggggaauccugaaugugagucuuugucaacagcaaguagcugguccuacauuguggaaaccucuucgucagacaacggaacuugcuauccaggcgauuucaucgacuacgaggagcucagggaacagcugagcaguguuuccucuuuugagcgguucgaaauuuuuccgaaaacaagcuccuggcccaaucacgauucaaacaaggguaucaccgccgcuuguccucaugcaggggccaagaguuucuauaaaaaucugauauggcucgugaagaaaggaaacagcuacccaaaguuaucuaaauccuauaucaaugacaagggcaaggagguccuggugcuuuggggcauucaccaccccucaacgagcgcugaucaacagaguuuguaccagaacgccgacgcguacguauuuguugggucuucccgcuauagcaaaaaguucaaaccugagaucgcaauucgaccaaaggugcgugaucaggaaggaagaaugaauuacuauuggacucuggucgagcccggugacaaaaucaccuuugaagccacaggcaaccuaguggugccuagguacgcuuucgccauggagcggaacgcagggucgggaauaauuaucucugauacuccaguccaugacugcaauaccacaugucaaaccccgaagggcgcuauuaacacgucccuccccuuucacaauauccauccuaucacuauugguaaaugcccaaaguauguuaagucaacaaaacugcgccuugccaccgggcugagaaacgugcccaguauacagagcaggggauuguucggcgcgaucgccggcuuuauugaagggggauggacugguaugguagacggcugguacggguaucaccaccagaaugagcagggauccggcuacgcagcugaucucaagucuacacaaaacgccaucgacgagauaaccaauaaagugaacagcgucauugaaaagaugaauacgcaguucaccgcuguggguaaagaguucaaccaucuggaaaagcggaucgagaauuuaaacaagaaaguugaugacggguuucuggauaucuggacauacaaugccgaacuccuugugcuguuggagaacgagcgcacucuagacuaucacgauucaaaugucaagaaccuguacgaaaaagugcgaagucagcucaagaacaaugcaaaagagauuggcaacggauguuucgaauuuuaucauaagugcgacaauaccuguauggaguccguaaagaacggcacauacgauuauccuaaauacagcgaagaggccaagcugaauagagaggaaaucgacgggguuaaacuugagucuacuaggauuuaucagauacuggcuaucuacucaaccguggcgaguagcuugguccucguggucucccugggagcaauuucuuucuggaugugcucgaacgguagcuuacaaugccggaucuguaucuga

SEQ ID NO: 127086 - RNA, 1701 nt, Artificial Sequence; identical to SEQ ID NO: 124927
  derived and/or modified sequence opt3 from hemagglutinin__InfluenzaA__ADI48762

SEQ ID NO: 127087 - RNA, 1701 nt, Artificial Sequence
  derived and/or modified sequence opt3 from hemagglutinin__InfluenzaA__ADI48772
auggaggccauccuggugguccuccuuuacaccuucgcuacagcaaacgccgacacucugugcauuggcuaucaggcgaauaacagcacggauaccguugacacaguguuggaaaagaauguaacugugacccacuccgucaacuuacuggaggauaaacauaaugggaagcuauguaaacucagaggaguggcuccccugcaccuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacaacugagcaguguguccucuuucgagcgguuugaaauuuucccgaaaacaagcuccuggcccaaucaugauucaaacaagggugucaccgccgcuuguccucacgcaggggccaagaguuuuuauaaaaaucugaucuggcucgugaagaaaggaaacagcuacccaaaguuaucuaaauccuauauaaaugacaagggcaaggagguacugguucuuuggggcauccaucaccccucaacgagcgcugaucagcagaguuuguaccagaacgccgacgcguacguguucgucgggucuucccgcuauagcaaaaaguuuaaaccugagauugcaauccgaccaaaggugcgugaucaagaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcacgacugcaauaccacaugucagaccccgaagggcgcuaucaacacgucccuccccuuccauaauauucacccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccagaaugagcaaggauccggcuacgcagcugaucucaagucuacacagaacgccauugacgagaucaccaauaaagugaacagcguuauagaaaagaugaauacgcaguuuaccgcuguggguaaagaguucaaccaccuggaaaagcggauugagaauuuaaacaagaaagucgaugacggguuccuggauaucuggacauacaaugccgaacuccuugugcuguuggagaacgagcgcacucuagacuaucaugauucaaauguaaagaaccuguacgaaaaaguucgaagucagcucaagaacaaugcaaaagagaucggcaacggauguuuugaguucuaucacaagugcgacaauaccuguauggaauccgugaagaacggcacauacgauuauccuaaauacagcgaagaggccaagcugaauagagaggaaauugacggggucaaacuugagucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 127088 - RNA, 1701 nt, Artificial Sequence
  derived and/or modified sequence opt3 from hemagglutinin__InfluenzaA__ADI48782
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaaagcaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 127089 - RNA, 1701 nt, Artificial Sequence
  derived and/or modified sequence opt3 from hemagglutinin__InfluenzaA__ADI48792
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacauuuucguggggucuucccgcuauagcaaaaaguuuaaaccugagaucgcaauucgaccaaagguccgugaucaggaaggaagaaugaauuacuauuggacucugguggagcccggugacaaaaucaccuucgaagccacaggcaaccuaguggucccuagguacgcuuuugccauggagcggaacgcagggucgggaauaauuaucucugauacuccaguucaugacugcaauaccacaugucaaaccccgaagggcgcuauuaacacgucccuccccuuccacaauauccauccuaucacuauugguaaaugcccaaaguaugugaagucaacaaaacugcgccuugccaccgggcugagaaacguacccaguauacagagcaggggauuguuuggcgcgaucgccggcuucauugaagggggauggacugguaugguggacggcugguacggguaucaccaccagaaugagcagggauccggcuacgcagcugaucucaagucuacacaaaacgccaucgacgagauaaccaauaaagucaacagcgugauugaaaagaugaauacgcaguuuaccgcuguugguaaagaguucaaccaucuggaaaagcggaucgagaauuuaaacaagaaaguggaugacggguuccuggauaucuggacauacaaugccgaacuccuuguccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacaaugccggaucuguaucuga

SEQ ID NO: 127090 - RNA, 1701 nt, Artificial Sequence
  derived and/or modified sequence opt3 from hemagglutinin__InfluenzaA__ADI49029
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuaucucggacaacggaacuugcuauccaggcgauuuuauugacuacgaggagcucagggaacagcugucaagcgugaguuccuucgagcgguuugaaaucuucccgaaaacaucuagcuggcccaaucacgauuccaacaagggugucaccgccgcuuguccucaugcaggggccaagucauuuuauaaaaaucugauauggcucgugaagaaaggaaacaguuacccaaaguuaagcaaaucuuauaucaaugacaagggcaaggagguacugguucuuuggggcauucaccaccccuccacgucagcugaucaacagagcuuguaccagaacgccgacgcguacguguucgucgggaguucucgcuauuccaaaaaguuuaaaccugagaucgcaauucgaccaaaggugcgugaucaggaaggaagaaugaauuacuauuggacucugguggagcccggugacaaaaucaccuucgaagccacaggcaaccuagucguuccuagguacgcuuuugccauggagcggaacgcagggagcggaauaauuaucucggauacuccagugcaugacugcaauaccacaugucaaaccccgaagggcgcuauuaacacgucucuccccuuccacaauauccauccuaucacuauugguaaaugcccaaaguauguaaaguccacaaaacugcgccuugccaccgggcugaagaacgugcccucaauacagaguagaggauuguuuggcgcgaucgccggcuucauugaagggggauggacugguauggucgacggcugguacggguaucaccaccagaaugagcagggaagcggcuacgcagcugaucucaaauccacacaaaacgccaucgacgagauaaccaauaaggugaacucuguuauugaaaagaugaauacgcaguuuaccgcuguggguaaggaguucaaccaucuggaaaagaggaucgagaauuuaaacaaaaaggucgaugacggguuccuggauaucuggacauacaaugccgaacuccuugugcuguuggagaacgagcggacucuagacuaucacgauagcaauguuaaaaaccuguacgaaaagguacgcucacagcucaaaaacaaugcaaaggagauuggcaacggauguuuugaguucuaucauaagugcgacaauaccuguauggaaagugugaaaaacggcacauacgauuauccuaaguacuccgaagaggccaaacugaaucgagaggaaaucgacggggucaaacuugagagcacuagaauuuaucagauacuggcuaucuacucuaccguggcgucaaguuugguccucgugguuagccugggagcaauuuccuuuuggaugugcucuaacgguucguuacaaugcaggaucuguaucuga

SEQ ID NO: 127091 - RNA, 1701 nt, Artificial Sequence; identical to SEQ ID NO: 124927
  derived and/or modified sequence opt3 from hemagglutinin__InfluenzaA__ADI49240

SEQ ID NO: 127092 - RNA, 1701 nt, Artificial Sequence; identical to SEQ ID NO: 124927
  derived and/or modified sequence opt3 from hemagglutinin__InfluenzaA__ADI49260

SEQ ID NO: 127093 - RNA, 1701 nt, Artificial Sequence
  derived and/or modified sequence opt3 from hemagglutinin__InfluenzaA__ADI49270
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacagcucaaaaacaaugcaagagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 127094 - RNA, 1701 nt, Artificial Sequence; identical to SEQ ID NO: 124927
  derived and/or modified sequence opt3 from hemagglutinin__InfluenzaA__ADI49280

SEQ ID NO: 127095 - RNA, 1701 nt, Artificial Sequence; identical to SEQ ID NO: 124927
  derived and/or modified sequence opt3 from hemagglutinin__InfluenzaA__ADI49312

SEQ ID NO: 127096 - RNA, 1701 nt, Artificial Sequence; identical to SEQ ID NO: 124927
  derived and/or modified sequence opt3 from hemagglutinin__InfluenzaA__ADI49322

SEQ ID NO: 127097 - RNA, 1701 nt, Artificial Sequence; identical to SEQ ID NO: 124927
  derived and/or modified sequence opt3 from hemagglutinin__InfluenzaA__ADI49332

SEQ ID NO: 127098 - RNA, 1701 nt, Artificial Sequence; identical to SEQ ID NO: 125254
  derived and/or modified sequence opt3 from hemagglutinin__InfluenzaA__ADI49342

SEQ ID NO: 127099 - RNA, 1701 nt, Artificial Sequence; identical to SEQ ID NO: 124927
  derived and/or modified sequence opt3 from hemagglutinin__InfluenzaA__ADI49352

SEQ ID NO: 127100 - RNA, 1701 nt, Artificial Sequence; identical to SEQ ID NO: 124685
  derived and/or modified sequence opt3 from hemagglutinin__InfluenzaA__ADI49362

SEQ ID NO: 127101 - RNA, 1701 nt, Artificial Sequence; identical to SEQ ID NO: 126237
  derived and/or modified sequence opt3 from hemagglutinin__InfluenzaA__ADI49382

SEQ ID NO: 127102 - RNA, 1701 nt, Artificial Sequence; identical to SEQ ID NO: 125038
  derived and/or modified sequence opt3 from hemagglutinin__InfluenzaA__ADI49392

SEQ ID NO: 127103 - RNA, 1701 nt, Artificial Sequence; identical to SEQ ID NO: 124672
  derived and/or modified sequence opt3 from hemagglutinin__InfluenzaA__ADI49717

SEQ ID NO: 127104 - RNA, 1701 nt, Artificial Sequence
  derived and/or modified sequence opt3 from hemagglutinin__InfluenzaA__ADI49727
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcauaauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 127105 - RNA, 1701 nt, Artificial Sequence; identical to SEQ ID NO: 124672
  derived and/or modified sequence opt3 from hemagglutinin__InfluenzaA__ADI49737

SEQ ID NO: 127106 - RNA, 1701 nt, Artificial Sequence; identical to SEQ ID NO: 124672
  derived and/or modified sequence opt3 from hemagglutinin__InfluenzaA__ADI49747

SEQ ID NO: 127107 - RNA, 1701 nt, Artificial Sequence; identical to SEQ ID NO: 124672
  derived and/or modified sequence opt3 from hemagglutinin__InfluenzaA__ADI49757

SEQ ID NO: 127108 - RNA, 1701 nt, Artificial Sequence; identical to SEQ ID NO: 124672
  derived and/or modified sequence opt3 from hemagglutinin__InfluenzaA__ADI49767

SEQ ID NO: 127109 - RNA, 1701 nt, Artificial Sequence
  derived and/or modified sequence opt3 from hemagglutinin__InfluenzaA__ADI49777
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcacugaucaacagagucuuuaccagaacgcugacgccuacguguucgucgggucuucccgcuauagcaagaaauuuaagccugagaucgcgauucgaccaaaagugcgugaucaggagggaagaaugaauuacuauuggaccuugguggaacccggugacaagaucacauucgaggcaacuggcaaccuggucguuccuagguacgccuuugcuauggaacggaacgccgggucgggaauaauuaucucugauaccccagugcaugacugcaauacaaccugucaaacgccgaaaggcgcaauuaacacuucccuacccuuccagaauauccacccuaucacaauugguaagugcccaaaguauguaaaaucaaccaagcuccgccuggcuacugggcuuagaaacgugcccaguauacagagcaggggacuguuuggcgccaucgcgggcuucauugaagggggauggacagguauggucgacggcugguacggguaucaucaccagaaugaacaaggauccggcuacgccgcagauuugaaaucuacccagaacgcuaucgacgagauaacgaauaaggugaacagcguuauugagaaaaugaauacccaguuuacagccguggguaaggaguucaaccaccucgagaagcggaucgaaaaucugaacaaaaaggucgaugacggguucuuagauaucuggacuuacaaugcugagcugcucgugcuucuggaaaacgagcgcaccuuggacuaucaugauucaaauguuaaaaaccuauacgagaagguacgaagucagcugaaaaacaaugccaaggaaauuggcaacggauguuuugaguucuaucacaagugcgacaauacauguauggaauccgugaaaaacggcacuuacgauuauccuaaguacagcgaggaagcaaaacucaauagagaggagaucgacggggucaagcuggaaucuaccaggauuuaucaaauacuugccaucuacucaacaguggcuaguagccuggucuuggugguuucccucggagcgauuucuuuuuggaugugcucgaacgguagccugcagugccggaucuguaucuga

SEQ ID NO: 127110 - RNA, 1701 nt, Artificial Sequence
  derived and/or modified sequence opt3 from hemagglutinin__InfluenzaA__ADI49787
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuauuucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 127111 - RNA, 1701 nt, Artificial Sequence; identical to SEQ ID NO: 126020
  derived and/or modified sequence opt3 from hemagglutinin__InfluenzaA__ADI49822

SEQ ID NO: 127112 - RNA, 1701 nt, Artificial Sequence
  derived and/or modified sequence opt3 from hemagglutinin__InfluenzaA__ADI50027
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaaguacuauuggacucugguggaacccggugacaaaauuaccuucgaggccacaggcaaucuagucguuccuagguacgcuuuugccauggaacggaacgcagggucgggaaucauaauuucugauacuccagugcaugacugcaacaccacaugucaaaccccgaagggcgcuaucaauacgucccuccccuuccagaacauucacccuaucacuaucgguaagugcccaaaauauguaaagucaacaaaacugcgccuugccaccgggcugagaaaugugcccaguauucagagcaggggauuguuuggcgcgauagccggcuucaucgaagggggauggacugguauggucgacggcugguacgggcaucaccaccagaacgaacaaggauccggcuaugcagcugaucucaagucuacacagaaugccauugacgagaucaccaacaaagugaauagcguuauagagaagaugaacacgcaguuuaccgcuguggguaaggaguucaaucaucuggaaaaacggauugaaaacuuaaauaagaaagucgaugacggguuccuggauaucuggacauacaacgccgagcuccuugugcuguuggaaaaugagcgcacucuagacuaccacgauucaaacguaaagaaucuguaugagaaaguucgaagucagcucaagaacaacgcaaaggaaaucggcaauggauguuuugaguucuaccauaaaugcgacaacaccuguauggaauccgugaagaauggcacauaugauuacccuaaauauagcgaggaagccaagcugaacagagaggagauugacgggaucaaacuugaaucuacuaggauuuaccaaauacuggcuaucuauucaaccgucgcgaguagcuuggugcucgucgugucccugggagcaauuucuuuuuggaugugcucgaaugguagcuuacagugccggaucuguaucuga

SEQ ID NO: 127113 - RNA, 1701 nt, Artificial Sequence
  derived and/or modified sequence opt3 from hemagglutinin__InfluenzaA__ADI52834
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaucccccuacgucagcugaucaacagagccuuuaccagaacgccgacgcguacguguucgucgggaguucucgcuauuccaagaaauuuaagccagagaucgcaauucgacccaaagugcgugaucaggagggaagaaugaauuacuauuggacuuugguggaaccuggugacaagaucaccuucgaggccacaggcaaccuggucguuccaagguacgcuuuugccauggaacggaacgcagggagcggaauaauuaucucggauacuccggugcacgacugcaauaccacaugucaaacccccaaaggcgcuauuaacacgucucuaccuuuccagaauauccacccaaucacuauugguaagugccccaaguauguaaaauccacaaagcuccgccuggccaccgggcuuagaaacgugccuucaauacagaguaggggacuguuuggcgcgaucgccggcuucauugaagggggauggacugguauggucgacggcugguacggguaucaucaccagaaugaacaaggaagcggcuacgcagcugauuugaaauccacacagaacgccaucgacgagauaaccaauaaggugaacucuguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauagcaauguuaaaaaccuauacgagaagguacgaucacagcugaaaaacaaugcaaaggaagugggcaacggauguuuugaguucuaucacaagugcgacaauaccuguauggaaagugucaaaaacggcacauacgauuauccaaaguacuccgaggaagccaaacucaauagagaggagauugacggggugaagcuggaaagcacuaggaucuaucaaauucuugcuauauacucuaccgcggcaucaagucuggucuuggugguuagccucggagccaucuccuuuuggaugugcucuaacgguucgcugcagugccggauuuguaucuga

SEQ ID NO: 127114 - RNA, 1701 nt, Artificial Sequence
  derived and/or modified sequence opt3 from hemagglutinin__InfluenzaA__ADI52835
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaucccccuacgucagcugaucaacagagcuuguaccagaacgccgacgcguacguguucgucgggaguucuaaauauuccaagaaauuuaagccagagauugcaauccgccccaaagugcgagaucaggaaggacguaugaauuacuauuggacucugguggagccuggugacaagauuaccuucgaagccacaggcaaccuagucguuccaagauacgcuuuugccauggagaggaacgcagggagcggaaucauaauuucggauacuccggugcacgacugcaauaccacaugucaaacccccaaaggcgcuaucaacacgucucucccuuuccacaauauucauccaaucacuaucgguaagugccccaaguauguaaaauccacaaagcugcggcuugccaccgggcugcgcaacgugccuucaauucagaguagaggauuguuuggcgcgauagccggcuucaucgaagggggauggacugguauggucgacggcugguacggguaucaccaccagaaugagcagggaagcggcuacgcagcugaucucaaauccacacaaaacgccauugacgagaucaccaauaaggugaacucuguuauagaaaagaugaauacgcaguuuaccgcuguggguaaggaguucaaccaucuggaaaagaggauugagaauuuaaacaaaaaggucgaugacggguuccuggauaucuggacauacaaugccgaacuccuugugcuguuggagaacgagcggacucuagacuaucacgauagcaauguuaaaaaccuguacgaaaagguacgcucacagcucaaaaacaaugcaaaggagaucggcaacggauguuuugaguucuaucauaagugcgacaauaccuguauggaaagugugaaaaacggcacauacgauuauccaaaguacuccgaagaggccaaacugaaucgagaggaaauugacggggucaaacuugagagcacuaaaaucuaucagauucuggcuauauacucuaccguggcgucaaguuugguccucgugguuagccugggagcaaucuccuuuuggaugugcucuaacgguucguuacaaugcagaauuuguaucuga

SEQ ID NO: 127115 - RNA, 1701 nt, Artificial Sequence
  derived and/or modified sequence opt3 from hemagglutinin__InfluenzaA__ADI52836
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaagagaacagcuacccaaaguuaucuaaauccuauauaaaugacaagggaaaggagguacugguucuuuggggcauccaccaccccucaacgagcgcugaucaacagcgcuuguaccagaacgccgacgcguacguguucgucggcaguucuaaauauuccaagaaauuuaagccugaaauugcaauccgaccaaaagugcgugaucaggaggggagaaugaauuacuauuggacucugguggaacccggagacaagauuaccuucgaggccacagguaaccuagucguuccuagguacgcuuuugccauggaacggaacgcaggcagcgggaucauaauuucggauacuccagugcaugacugcaauaccacaugucaaaccccgaaaggagcuaucaacacgucucuccccuuccacaauauucauccuaucacuaucggcaagugcccaaaguauguaaaauccacaaagcugcgccuugccaccggucugagaaacgugcccucaauucagaguaggggguuguuuggagcgauagccggcuucaucgagggcggguggacuggaauggucgacgguugguacggcuaucaccaccagaaugagcaggggagcggauacgcagcugaucucaaauccacacaaaacgccauugacgaaaucaccaauaaggugaacucuguuauagagaaaaugaauacgcaguuuaccgcugugggcaaggaguucaaccaucuggaaaagcggauugaaaauuuaaacaaaaaggucgaugacgguuuccuggauaucuggacauacaaugccgagcuccuugugcuguuggagaacgaacgcacucuagacuaucacgauagcaauguaaagaaccuguacgagaagguucgaucacagcucaaaaacaaugcaaaggaaaucgggaacggcuguuuugaguucuaucauaagugcgacaauaccuguauggaaagugugaaaaacggaacauacgauuauccuaaguacuccgaggaggccaaacugaauagagaagagauugacggcgucaaacuugaaagcacuaaaaucuaucagauucuggcuauauacucuaccguggcgucaaguuugguccucgugguuagccugggggcaaucuccuuuuggaugugcucuaacggaucguuacaaugcaggauuuguaucuga

SEQ ID NO: 127116 - RNA, 1701 nt, Artificial Sequence
  derived and/or modified sequence opt3 from hemagglutinin__InfluenzaA__ADI52837
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggugaaacacaaugggaagcuauguaaacucagaggaguugcuccccugcaucuugguaagugcaacauagccggcuggauccuggggaauccugaaugugagucuuugucaacagcaaguagcugguccuacauuguggaaaccucuucgucagauaacggaacuugcuauccaggcgacuuuaucgauuacgaggagcucagggaacagcugagcagugucuccucuuucgagcgguuugaaauuuucccgaaaacaagcuccuggcccaaucacgacucaaacaagggugugaccgccgcuuguccucaugcaggggccaagaguuuuuauaaaaaucugaucuggcucguaaagaaaggaaacagcuacccaaaguuaucuaaauccuauauaaaugauaagggcaaggagguucuggugcuuuggggcauccaccaccccucaacgagcgcugaccaacagaguuuguaccagaacgccgaugcguacgucuucguggggucuuccaaauauagcaagaaauuuaagccugagauugcaauccgcccaaaagugcgagaccaggaaggacguaugaauuacuauuggacucuggucgagcccggugauaagauuaccuucgaagccaacggcaaccuaguugugccuagauacgcuuuugccauggagaggaaugcagggucgggaaucauaauuucugacacaccaguacaugauugcaacacuaccugucaaacaccgaaaggcgcuaucaauaccucccuccccuuccacaacauucauccuaucacgaucgguaagugcccaaaguaugugaaaucaacuaagcugcggcuugccacagggcugcgcaauguccccaguauucagagcagaggauuguuuggcgcgauagccggcuucaucgaagggggauggaccgguaugguggacggcugguacggguaucaccaccagaacgagcagggauccggcuacgcagcugaccucaaaucuacucaaaaugccauugaugagaucacaaacaagguuaauagcgugauagaaaagaugaacacccaguuuacggcugucgguaaggaguucaaucaucuggaaaagaggauugagaacuuaaauaaaaagguggacgauggguuccuggacaucuggaccuacaacgccgaacuccuuguacuguuggagaaugagcggacacuagauuaucacgacucaaacguuaaaaaccuguacgaaaaggugcgcagucagcucaaaaauaacgcaaaggagaucggcaauggauguuuugaguucuaucauaagugcgauaacacuuguauggaauccgucaaaaauggcaccuacgacuauccuaaguacagcgaagaggccaaacugaaccgagaggaaauugauggggugaaacuugagucuacaaaaaucuaucagauucuggcuauauacucaacugucgcgaguagcuuggugcucguugugucccugggagcaaucucuuuuuggaugugcucgaaugguagcuuacaaugcagaauuuguaucuga

SEQ ID NO: 127117 - RNA, 1701 nt, Artificial Sequence; identical to SEQ ID NO: 125483
  derived and/or modified sequence opt3 from hemagglutinin__InfluenzaA__ADI72915

SEQ ID NO: 127118 - RNA, 1701 nt, Artificial Sequence; identical to SEQ ID NO: 125483
  derived and/or modified sequence opt3 from hemagglutinin__InfluenzaA__ADI72916

SEQ ID NO: 127119 - RNA, 1701 nt, Artificial Sequence; identical to SEQ ID NO: 125483
  derived and/or modified sequence opt3 from hemagglutinin__InfluenzaA__ADI72917

SEQ ID NO: 127120 - RNA, 1701 nt, Artificial Sequence
  derived and/or modified sequence opt3 from hemagglutinin__InfluenzaA__ADI72918
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugaccgcggcaaggaaguacugguucuuuggggcauccaccacccuuccacgucagcugaucaacagagcuuguaccagaacgccgacgcguacguguucgucgggaccagucgauauucuaaaaaguuuaaaccagagauugcaauccgucccaaggugagagaucaggagggaaggaugaauuacuauuggacucugguggaaccuggugacaaaauuacauucgaggccacuggcaaccuagucguuccacgguacgcuuuugccauggaacgcaacgcaggguccggaaucauaauuagcgauaccccggugcaugacugcaauacaaccugucaaacgcccaagggcgcuaucaacacuucgcucccuuuccagaauauucacccaaucacaaucgguaaaugccccaaguauguaaagucuaccaaacugagacuugccacugggcugaggaacgugccuuccauucagucacggggauuguuuggcgcgauagccggcuucaucgaagggggauggacagguauggucgacggcugguacggguaucaucaccagaaugaacaaggaaguggcuacgcagcugaucucaagagcacccagaacgccauugacgagaucacgaauaaagugaacuccguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauucuaauguaaagaaacuguacgagaagguuagaagccagcucaaaaacaacgcaaaggaaaucggcaauggauguuuugaguucuaucacaagugcgacaacacauguauggaaucagugaaaaauggcacuuacgauuauccaaaguacagugaggaagccaaacugaacagggaggagauugacggggucaaacuugaauccacccggaucuaucaaauucuggcuauauacagcacaguggcgucuucauugguccucgugguuagucugggagcaaucagcuuuuggaugugcuccaaugguucuuuacagugccguauuuguaucuga

SEQ ID NO: 127121 - RNA, 1701 nt, Artificial Sequence; identical to SEQ ID NO: 125483
  derived and/or modified sequence opt3 from hemagglutinin__InfluenzaA__ADI72919

SEQ ID NO: 127122 - RNA, 1701 nt, Artificial Sequence; identical to SEQ ID NO: 125483
  derived and/or modified sequence opt3 from hemagglutinin__InfluenzaA__ADI72920

SEQ ID NO: 127123 - RNA, 1701 nt, Artificial Sequence
  derived and/or modified sequence opt3 from hemagglutinin__InfluenzaA__ADI72921
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuagccgcuauucuaagaaauuuaagccagagauugcaauccgacccaaagugcgugaucaggagggaagaaugaauuacuauuggacccugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgcccuggacgagauuacgaauaaggugaacuccguuaucgagaaaaugaauacccaguuuacagcuguggguaaggaguucaaccacuuagaaaagcggauagaaaaucugaacaaaaaggucgaugacggguuccucgauauuuggacuuacaaugccgagcuucugguguugcuagaaaacgagcgcacccuggacuaucaugauucuaauguuaaaaaccucuacgagaagguacgaagccagcugaaaaacaaugcaaaggaaaucggcaacggauguuuugaguucuaucacaagugcgacaauacauguauggaaucagugaaaaacggcacuuacgauuauccaaaguacagugaggaagccaaacuuaauagagaggagaucgacggggucaagcuggaauccaccaggauuuaucaaaucuuggcuauuuacagcacaguggcgucuucacucguccuggugguuaguuuaggagcaauaaguuuuuggaugugcuccaacgguucucugcagugccggaucuguauuuga

SEQ ID NO: 127124 - RNA, 1701 nt, Artificial Sequence; identical to SEQ ID NO: 124685
  derived and/or modified sequence opt3 from hemagglutinin__InfluenzaA__ADI72922

SEQ ID NO: 127125 - RNA, 1701 nt, Artificial Sequence
  derived and/or modified sequence opt3 from hemagglutinin__InfluenzaA__ADI72923
augaaggccauccuggugguccuccuuuacaccuucgcuacaagcaacgcagacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauccuaacaagggugucaccgcagccuguccacaugcuggggcaaaaaguuuuuauaagaaucugaucuggcucgugaaaaagggaaacagcuaccccaaauuaucuaaguccuauauaaaugacaagggcaaagaaguacugguucuuuggggcauccaccacccuucaacgagcgccgaucaacagaguuuguaccagaacgcugacgccuacguguucgucgggacuucucgcuauuccaagaaauuuaagccagagauugcgauccgacccaaagugcgugaucaggagggaagaaugaauuacuauuggacccugguggaaccuggugacaagauuacauucgaggcaacuggcaaccuagucguuccaagguacgccuuugcuauggaacggaacgccgggccgggaaucauaauuagcgauacccccgugcaugacugcaauacaaccugucaaacgccuaaaggcgcaaucaacacuucgcucccauuccagaauauucaccccaucacaaucgguaagugcccuaaguauguaaaaucuaccaagcugcgccuugcuacugggcugagaaacgugccauccauucagucaaggggauuguuuggcgccauagcgggcuucaucgaagggggauggacagguauggucgacggcugguacggguaucaucaccagaaugaacaaggaaguggcuacgccgcagaucucaaaagcacccagaacgcuauugacgagaucacgaauaaggugaacuccguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucuaauguaaagaaccuguacgagaagguucgaagccagcucaaaaacaaugccaaggaaaucggcaacggauguuuugaguucuaucacaagugcgacaauacauguauggaaucagugaaaaacggcacuuacgauuaucccaaguacagugaggaagcaaaacugaauagagaggagauugacggggucaaacuugaauccaccaggaucuaucaaauucuggccauauacagcacaguggcuucuucauugguccucgugguuagucugggagcgaucagcuuuuggaugugcuccaacgguucuuuacagugccggauuuguaucuga

SEQ ID NO: 127126 - RNA, 1701 nt, Artificial Sequence; identical to SEQ ID NO: 125483
  derived and/or modified sequence opt3 from hemagglutinin__InfluenzaA__ADI72924

SEQ ID NO: 127127 - RNA, 1701 nt, Artificial Sequence; identical to SEQ ID NO: 124685
  derived and/or modified sequence opt3 from hemagglutinin__InfluenzaA__ADI72925

SEQ ID NO: 127128 - RNA, 1701 nt, Artificial Sequence
  derived and/or modified sequence opt3 from hemagglutinin__InfluenzaA__ADI72926
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccaguggauauucuaagaaauuuaagccagagauugcaauccgccccaaagugcgagaucaggagggucguaugaauuacuauuggacucugguggaaccuggcgacaagauuacauucgaggccacugggaaccuagucguuccaagauacgcuuuugccauggaaaggaacgcaggauccggcaucauaauuagcgauaccccggugcaugacugcaauacaaccugucaaacgcccaaaggugcuaucaacacuucgcucccuuuccagaauauucacccaaucacaaucgggaagugccccaaguauguaaaaucuaccaagcugcggcuugccacuggacugcgcaacgugccuuccauucagucaagaggcuuguuuggcgcgauagccggguucaucgagggagguuggacaggcauggucgacgggugguacggauaucaucaccagaaugaacaaggcagugguuacgcagcugaucucaaaagcacccagaacgccauugacgagaucacgaauaaggugaacuccguuauagagaaaaugaauacccaguuuacagcuguggggaaggaguucaaccaccuggagaagaggauugaaaauuuaaacaaaaaggucgaugacggcuuccuggauaucuggacuuacaaugccgagcuccuugugcuguuggaaaacgagcggacccuagacuaucaugauucuaauguaaagaaccuguacgagaagguucgcagccagcucaaaaacaaugcaaaggaaaucggaaacggcuguuuugaguucuaucacaagugcgacaauacauguauggaaucagugaaaaacgggacuuacgauuauccaaaguacagugaggaagccaaacugaaucgagaggagauugacggagucaaacuugaauccaccagaaucuaucaaauucuggcuauauacagcacaguggcgucuucauugguccucgugguuagucugggugcaaucagcuuuuggaugugcuccaacggcucuuuacagugcaggauuuguaucuga

SEQ ID NO: 127129 - RNA, 1701 nt, Artificial Sequence
  derived and/or modified sequence opt3 from hemagglutinin__InfluenzaA__ADI72927
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuagccgcuauucuaagaaauuuaagccagagauugcaauccgacccaaagugcgugaucaggagggaagaaugaauuacuauuggacccugguggaaccuggugacaagauuacauucgaggccacuggcaaccuagucguuccaagguacgcuuuugccauggaacggaacgcaggguccggaaucauaaccagcgauacaccggugcaugacugcaauaccacgugucaaacucccaaaggcgcuauuaacacaucgcucccuuuccagaauauccacccaauuaccaucgguaagugccccaaguauguaaaaucuacuaagcugcgccuugccacagggcugagaaacgugccuuccauccagucaaggggauuguuuggcgcgauugccggcuucauagaagggggauggaccgguauggucgacggcugguacggguaucaucaccagaaugaacaaggaaguggcuacgcagcugaucucaaaagcacgcagaacgccaucgacgagauuaccaauaaggugaacuccguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauucuaauguaaagaaccuguacgagaagguucgaagccagcucaaaaacaaugcaaaggaaaucggcaacggauguuuugaguucuaucacaagugcgacaauacuuguauggaaucagugaaaaacggcaccuacgauuauccaaaguacagugaggaagccaaacugaauagagaggagaucgacggggucaaacuugaauccacaaggauuuaucaaauccuggcuauuuacagcaccguggcgucuucauugguccucgugguuagucugggagcaauaaguuuuuggaugugcuccaacgguucuuuacagugccggaucuguauuuga

SEQ ID NO: 127130 - RNA, 1701 nt, Artificial Sequence
  derived and/or modified sequence opt3 from hemagglutinin__InfluenzaA__ADI72928
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauccuaacaagggugugaccgccgcuuguccacaugcaggggccaaaucauuuuauaagaaucugauauggcucgucaaaaagggaaacaguuaccccaaauuaagcaagucuuauaucaaugacaagggcaaagaagugcugguacuuuggggcauucaccacccuuccacgucagcugaucaacagagcuuguaccagaacgccgacgcguacguuuucguggggaccagucgcuauucuaagaaauuuaagccagagaucgcaauucgacccaaaguccgugaucaggagggaagaaugaauuacuauuggacucugguggaaccuggugacaagaucacauucgaggccacuggcaaccuaguggucccaagguacgcuuuugccauggaacggaacgcaggguccggaauaauuaucagcgauaccccgguucaugacugcaauacaaccugucaaacgcccaaaggcgcuauuaacacuucgcucccuuuccagaauauccacccaaucacaauugguaagugccccaaguaugugaaaucuaccaagcugcgccuugccacugggcugagaaacguaccuuccauacagucaaggggauuguuuggcgcgaucgccggcuucauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggcaacggauguuuugaguucuaucacaagugcgacaauacauguauggaaucaguuaaaaacggcacuuacgauuauccaaaguacagugaggaagccaaacugaauagaaaggagaucgacggggugaaacuugaguccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 127131 - RNA, 1701 nt, Artificial Sequence; identical to SEQ ID NO: 124685
  derived and/or modified sequence opt3 from hemagglutinin__InfluenzaA__ADI72929

SEQ ID NO: 127132 - RNA, 1701 nt, Artificial Sequence; identical to SEQ ID NO: 124685
  derived and/or modified sequence opt3 from hemagglutinin__InfluenzaA__ADI72930

SEQ ID NO: 127133 - RNA, 1701 nt, Artificial Sequence
  derived and/or modified sequence opt3 from hemagglutinin__InfluenzaA__ADI72931
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagagaggagauugacgggaucaaacuugaauccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 127134 - RNA, 1701 nt, Artificial Sequence; identical to SEQ ID NO: 126341
  derived and/or modified sequence opt3 from hemagglutinin__InfluenzaA__ADI72932

SEQ ID NO: 127135 - RNA, 1698 nt, Artificial Sequence
  derived and/or modified sequence opt3 from hemagglutinin__InfluenzaA__ADI75818
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuauaaaaacuuacuguggcuuaccgagaagaauggauuguaccccaaccugagcaaaucuuaugcaaauaacaaggaaaaagaggugcuaguucucuggggcgugcaccacccuccauccaucucagaccagaagacgcuguaccauacugaaaacgccuacgucagcguggugaguucucacuauucccggaaguucacccccgagauagcuaaacgcccuaagguccgagaucaggagggccguaucaauuacuauuggacacuucuggaaccaggggacacuauuaucuuugaggcaaacggaaauuugauugccccgagauacgcuuucgcccucagcagggguuuuggcucggggaucauaaacucuaaugcgcccauggauaaaugugacgcaaagugccagaccccucaaggagccauuaacuccucacugccauuccagaauguucaucccgugacaaucggcgaauguccuaaauauguacggagugcuaaguuacgcauggugaccggucugagaaacauuccaagcauccaguccagggggcucuuuggagccaucgcaggcuucauugagggcggguggacgggaauggucgaugguugguacggcuaucaccaccagaaugaacaagggucuggauacgcugccgaccagaaaagcacucagaacgcgauaaauggcaucacaaacaagguaaauucaguuauugagaagaugaacacccaguuuacugccguggguaaagaguucaauaaacuugaacggcgcauggagaaccugaacaaaaaggucgaugacggguucaucgauauauggacauacaaugcagaauugcuagugcugcucgagaacgaacgaacccuggacuuucaugacaguaauguaaagaaccuuuaugagaagguuaagaaucaacugaaaaacaaugcuaaggagauuggcaacggaugcuucgaauuuuaccacaaauguaaugaugagugcauggaauccgugaagaacggcacguaugacuaccccaaauauagcgaggagucuaaguugaauagagaaaagaucgauggggucaaacucgagucaaugggaguguaccagauccuggccauuuauaguaccgucgcuagcuccuuagugcugcuaguuucucucggugccaucucguucuggaugugcagcaacggcucccugcaguguaggauuugcauauga

SEQ ID NO: 127136 - RNA, 1698 nt, Artificial Sequence
  derived and/or modified sequence opt3 from hemagglutinin__InfluenzaA__ADI75851
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcggacuccugauuaguaaagaaagcugguccuacaucguugagaagccaaacccggaaaauggcaccuguuaucccggucauuuugcugauuacgaggagcugagagaacaacucucuucggugagcucauucgagagguuugaaauuuucccuaaggagaguuccuggccaaaccacacugucacaggggugucugccagcugcucccauaauggagagucaaguuuuuaucggaacuuacuguggcuuaccggcaaaaauggcuuguaccccaaccugagcaagucuuaugcaaauaacaaagaaaaggagguucuaguacucuggggagugcaccacccuccaaacaucgucgaccagaaaacgcuguaccgcacugaaaaugccuacguguccguggucucaagccauuauagucgaaaguucacccccgagauagcuaagcguccuaaaguuagagaucaggaagggaggaucaacuacuauuggacacuucuggagccaggugacacuauuaucuuugaggcaaauggcaacuugauugccccgcgguacgcuuucgcccucucucgcggguuuggauccggcaucauaaauagcaacgcgcccauggguaagugugaugcaaaaugccagaccccucaaggggccauuaauucgucucugccauuccagaacgugcaccccguaacaaucggagaauguccuaaguaugugagauccgcuaaauuaaggauggucaccggccugcggaauauuccaucaauccagagucgcggccucuuuggggccaucgcaggauucauugaggguggcuggacggggaugguggacggaugguacggcuaucaucaccagaacgaacaagguagcggguacgcugccgaucagaaguccacucagaaugcgauaaacggcaucacaaauaaaguuaacucugugauugagaagaugaauacccaguuuacugccgucggaaaggaguucaacaaacuugaacgaagaauggagaaccugaauaagaaaguggacgauggcuucaucgacauauggacauacaacgcagaauugcuaguacugcucgagaaugaaaggacccuggauuuucacgacagcaacguuaagaaucuuuaugagaaagugaagucacaacugaagaacaaugcuaaagaaauugggaacggaugcuucgaguuuuaccauaaguguaaugacgagugcauggaaagugucaaaaacgguacguaugauuaccccaaguauuccgaggaaagcaaauugaaucgggagaagaucgacggcgugaagcucgagucuaugggggucuaccagauccuggccauuuauucaaccguggcuaguagcuuaguucugcuagugucccucggagccaucucuuucuggaugugcucgaacggcagccugcagugucguauuugcauauga

SEQ ID NO: 127137 - RNA, 1701 nt, Artificial Sequence; identical to SEQ ID NO: 124450
  derived and/or modified sequence opt3 from hemagglutinin__InfluenzaA__ADI75884

SEQ ID NO: 127138 - RNA, 1701 nt, Artificial Sequence; identical to SEQ ID NO: 124450
  derived and/or modified sequence opt3 from hemagglutinin__InfluenzaA__ADI75917

SEQ ID NO: 127139 - RNA, 1698 nt, Artificial Sequence
  derived and/or modified sequence opt3 from hemagglutinin__InfluenzaA__ADI77349
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaaguacuaauccucuggggcguucaccacccuccaaauauggccgaccagaaaacgcuguaccauacugagaacgcuuacgugucugucguguccucacacuauagccgcaaguucacccccgaaauagcaaagcgaccuaaagugcgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacaccaaaugccagacaccucaaggcgccauuaacagcucgcugccauuccagaauguccaucccguuaccaucggugaguguccuaaguaugugcgcucugcuaaauuaagaaugguaacggggcugaggaacauuccauccauccagucacggggacucuuuggcgccaucgcaggcuucauugaagggggauggacugguaugguggauggcugguacggguaucaccaccagaaugagcaaggaaguggcuacgcugccgaccagaaaagcacacagaacgcgauaaaugguaucaccaacaaagucaauuccgugauugaaaagaugaacacucaguuuacagccguugggaaggaguucaacaaacuugagcgccgaauggaaaaucugaacaagaaaguggaugacggcuucaucgauauauggaccuacaaugcagaguugcuaguccugcucgaaaacgagagaacgcuggacuuucaugacucuaaugugaagaaccuuuaugaaaaaguaaagagccaacugaagaauaacgcuaaagagauuggaaauggcugcuucgaguuuuaccacaaguguaacgaugaaugcauggagucaguuaaaaaugggaccuaugacuaccccaaguauagugaagaguccaaauugaacagggagaagaucgauggagugaagcucgaaagcaugggugucuaccagauccuggccauuuauucuacaguggcuucaaguuuaguccugcuagugagccucggcgccaucuccuucuggaugugcucuaaugggucgcugcagugucggauuugcauauga

SEQ ID NO: 127140 - RNA, 1701 nt, Artificial Sequence; identical to SEQ ID NO: 124685
  derived and/or modified sequence opt3 from hemagglutinin__InfluenzaA__ADI77360

SEQ ID NO: 127141 - RNA, 1701 nt, Artificial Sequence
  derived and/or modified sequence opt3 from hemagglutinin__InfluenzaA__ADI99498
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaaauaagucuuauauaaacgacaagggcaaagaaguacugguucuuuggggcauccaccaccccuccacuucagccgaucaacagagcuuguaccagaaugcugacgccuacguguucgucgggaccagucgcuauucuaagaaauuuaagccugagauugcgauccgaccaaaagugcguggacaggaggguagaaugaacuacuauuggacacuggugaagcccggcgauaaaauuacuuucgaagcaaccgggaaccuagucguuccuagguacgccuuugcuauggagcggaaugccggauccggcaucauaauuagcgacacaccagugcaugauugcaacaccacgugucaaacuccgaagggugcaaucaauacaucgcuccccuuccagaacauucacccuaucaccaucgggaagugcccaaaauauguaaagucuacuaaacugcgccuugcuacaggacugagaaaugugcccuccauucagucaaggggcuuguuuggcgccauagcgggguucaucgaaggagguuggaccggcauggucgacgggugguacggauaucaucaccagaacgagcaaggcagugguuacgccgcagaccucaagagcacgcagaaugcuauugaugaaaucaccaacaaaguuaauuccgugauagagaagaugaacacacaguuuacugccguggggaaggaguucaaucaccuggaaaaacggauugagaacuuaaauaagaaagucgacgauggcuuccuggacaucuggaccuacaacgcugaacuccuugugcuguuggagaaugaacgcacacuagauuaucaugacucuaacguaaagaaccuguacgagaaaguucgaagccagcucaagaauaacgccaaggagaucggaaauggcuguuuugaguucuaucacaaaugcgauaacacuuguauggagucagugaagaaugggaccuacgacuauccuaaauacagugaagaggcaaagcugaacagagaagagauugauggagucaaacuugaguccacaaggaucuaucaaauucuggccauauacagcaccguggcuucuucauugguccucgugguuagucugggugcgaucagcuuuuggaugugcuccaauggcucuuuacagugccggauuuguaucuga

SEQ ID NO: 127142 - RNA, 1701 nt, Artificial Sequence
  derived and/or modified sequence opt3 from hemagglutinin__InfluenzaA__ADI99560
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagaucggcaauggauguuuugaguucuaucacaaaugcaacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127143 - RNA, 1701 nt, Artificial Sequence; identical to SEQ ID NO: 127142
  derived and/or modified sequence opt3 from hemagglutinin__InfluenzaA__ADI99570

SEQ ID NO: 127144 - RNA, 1701 nt, Artificial Sequence; identical to SEQ ID NO: 127142
  derived and/or modified sequence opt3 from hemagglutinin__InfluenzaA__ADI99580

SEQ ID NO: 127145 - RNA, 1701 nt, Artificial Sequence; identical to SEQ ID NO: 126298
  derived and/or modified sequence opt3 from hemagglutinin__InfluenzaA__ADI99590

SEQ ID NO: 127146 - RNA, 1701 nt, Artificial Sequence
  derived and/or modified sequence opt3 from hemagglutinin__InfluenzaA__ADI99610
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaauccugguacuuuggggcauucaccaccccucaacgagcgcugaccaacagaguuuguaccagaaugccgaugcguacguuuucguggggacuucucgcuauuccaagaaauuuaagccugagaucgcaauucgaccaaaaguccgugaccaggagggaagaaugaacuacuauuggacccugguggaacccggugauaagaucacauucgaggccacuggcaaccuaguggucccuagguacgcuuuugccauggaacggaaugcagggagcggaauaauuaucucggacaccccaguucaugauugcaacacaaccugucaaacgccgaaaggcgcuauuaauacuucucuccccuuccagaacauccacccuaucacaauugguaagugcccaaaguaugugaaauccaccaagcugcgccuugccacugggcugagaaauguacccucaauacagaguaggggauuguuuggcgcgaucgccggcuucauugaagggggauggacagguaugguggacggcugguacggguaucaucaccagaacgaacaaggaagcggcuacgcagcugaccucaaauccacccagaaugccaucgauaagauaacgaacaaagucaauucugugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaccuguacgagaaaguacgaucacagcucaagaauaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127147 - RNA, 1701 nt, Artificial Sequence
  derived and/or modified sequence opt3 from hemagglutinin__InfluenzaA__ADI99620
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuaccgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaagccagcucaagaauaacgcaaaggagaucggcaauggauguuuugaguucuaucacaaaugcgauaacacuuguauggaaucagugaagaauggcaccuacgacuauccuaaauacagugaagaggccaagcugaacagagaagagauugauggggucaaacuugaguccacaaggaucuaucaaauucuggcuauauacagcaccguggcgucuucauugguccucgugguuagucugggagcaaucagcuuuuggaugugcuccaaugguucuuuacagugccggauuuguaucuga

SEQ ID NO: 127148 - RNA, 1701 nt, Artificial Sequence
  derived and/or modified sequence opt3 from hemagglutinin__InfluenzaA__ADI99630
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagaauaacgggaaacuauguaagcucagaggaguggcuccccugcaccuugguaaaugcaauauagccggcuggauccuggggaacccugagugugaaucuuugucaacagcaaguagcugguccuacauuguugagaccucuucgucagacaauggaacuugcuauccaggcaacuuuaucgauuacgaggagcucagggagcagcugagcaguguguccucuuucgaacgguuugagauuuucccgaagacaagcuccuggcccaaucaugacucaaacaagggugucaccgccgcuuguccucacgcaggggccaaaaguuuuuauaagaaucugaucuggcucgugaaaaagggaaacagcuacccaaaauuaucuaaguccuauauaaaugauaagggcaaagaaguacugguucuuuggggcauccaucaccccucaacgagcgcugaccaacagaguuuguaccagaacgccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcacgauugcaauacaaccugucaaacgccgaaaggcgcuaucaacacuucucuccccuuccagaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaucagaaugaacaaggaagcggcuacgcagcugaccucaaauccacccagaacgccauugauaagaucacgaauaaagugaacucuguuauagagaagaugaauacccaguuuacagcuguggguaaggaguucaaccaccuggaaaaacggauugagaauuuaaacaagaaagucgacgauggguuccuggacaucuggacuuacaaugccgaacuccuugugcuguuggagaacgaacgcacccuagauuaucacgacagcaacguaaagaaucuguacgagaaaguucgaucacagcucaagaacaaugcaaaggagaucggcaacggauguuuugaguucuaucauaaaugcgauaauacauguauggaaagugugaagaacggcacuuacgacuauccuaaauacuccgaagaggccaagcugaauagagaagagauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127149 - RNA, 1701 nt, Artificial Sequence
  derived and/or modified sequence opt3 from hemagglutinin__InfluenzaA__ADI99640
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacucuuacguguucgucgggaccucccgcuauagcaagaaauuuaagccugagauugccauccgaccaaaagugcgugaucaggagggaagaaugaauuacuauuggacacugguggaacccggugacaagauuacuuucgaggcgaccggcaaccuagucguuccuagguacgcauuugccauggaacggaacgcugggucgggaaucauaauuucugauacaccaauccaugacugcaauaccacgugucaaacuccggagggcgccauuaacacaucccuccccuuccagaauauccacccuaucaccauugguaaaugcccaaaguaugugaagucaacuaaacugcgccuugcaacagggcugagaaacguacccaguauacagagcaggggauuguuuggcgcuaucgccggcuucauugaagggggauggaccgguaugguggacggcugguacggguaucaucaccagaaugagcaaggauccggcuacgcggccgaucucaagucuacgcagaacgcaaucgacgagauaaccaauaaagucaacagcgugauugaaaagaugaauacacaguuuacugcuguugguaaagaguucaaccaccuggaaaagcggaucgagaauuuaaacaagaaaguggaugacggguuccuggauaucuggaccuacaaugccgaacuccuuguccuguuggagaacgagcgcacacuagacuaucaugauucaaaugugaagaaccuguacgaaaaaguacgaagucagcucaagaacaaugcuaaagagauuggcaacggauguuuugaguucuaucacaagugcgacaauacuuguauggaguccguuaagaacggcaccuacgauuauccuaaauacagcgaagaggccaagcugaauagagaggaaaucgacggggugaaacuugagucuacaaggauuuaucaaauacuggcaaucuacucaaccgucgccaguagcuuggugcucgucgugucccugggagcuauuucuuuuuggaugugcucgaacgguagcuuacagugccggaucuguaucuga

SEQ ID NO: 127150 - RNA, 1701 nt, Artificial Sequence; identical to SEQ ID NO: 126237
  derived and/or modified sequence opt3 from hemagglutinin__InfluenzaA__ADI99660

SEQ ID NO: 127151 - RNA, 1701 nt, Artificial Sequence
  derived and/or modified sequence opt3 from hemagglutinin__InfluenzaA__ADI99670
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacggguauccuaaguacuccgaggaagccaaacucaauagagaggagaucgauggagucaagcuggaaagcaccaggauuuaucaaauacuugcuaucuacucuacaguggcgucaagucuggucuuggugguuagccucggugcaauuuccuuuuggaugugcucuaacggcucgcugcagugccggaucuguaucuga

SEQ ID NO: 127152 - RNA, 1701 nt, Artificial Sequence
  derived and/or modified sequence opt3 from hemagglutinin__InfluenzaA__ADI99680
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccaucguggaacccggugacaagauaacauucgaggccacuggcaacuuggucguuccuagguacgcuuuugccauggaacggaacgcagggagcggaauuaucauuucggauaccccagugcaugacugcaauacaaccugucaaacgccgaaaggcgcuaucaacacuucucugcccuuccagaauauccacccuauuacaauagguaagugcccaaaguauguaaaauccaccaagcuacgccucgccacugggcugagaaacgugcccucaauccagaguaggggacuuuuuggcgcgauugccggcuucaucgaagggggauggacagguauggucgacggcugguacggguaucaucaccagaaugaacaaggaagcggcuacgcagcugaucugaaauccacccagaacgccauagacgagauuacgaauaaggugaacucuguuaucgagaaaaugaauacccaguuuacagcuguggguaaggaguucaaccacuuggagaagcggaucgaaaaucucaacaaaaaggucgaugacggguuccuggauauuuggacuuacaaugccgaguuacuggugcuccuugaaaacgagcgcacccuggacuaucaugauagcaauguuaaaaacuuguacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacuaaauagagaggagauugacggggucaagcucgaaagcaccaggauauaucaaauccuggcuauuuacucuacaguggcgucaagucuuguccuggugguuagcuugggagcaaucuccuuuuggaugugcucuaacgguucgcuccagugccggaucuguauuuga

SEQ ID NO: 127153 - RNA, 1701 nt, Artificial Sequence
  derived and/or modified sequence opt3 from hemagglutinin__InfluenzaA__ADI99690
augaaggccauccuggcugugcuccuuuacaccuucgcaauugccaacgcggacacacugugcauaggcuaucacgcuaauaacagcacugauacggucgacaccguuuuggagaaaaaugugacaguaacucauuccgugaacaucuuagaagauaagcacaaugggaaacuguguaagcuaagaggagucgcaccccuccaucuggguaaaugcaacauugccggcuggauccuugggaauccugagugugaaucucugucaaccgccaguagcugguccuacauuguggagacaucuucgucagacaacggaaccugcuauccaggcgauuuuaucgacuacgaagaguugagggagcagcucagcaguguuuccucuuucgaacgguuugagauauucccgaagacuagcuccuggcccaaucacgauucaaacaagggugugacagcugcauguccucaugccggggcuaaaaguuuuuauaagaaucugaucuggcuggucaaaaagggaaacagcuacccaaaacucucuaaguccuauauuaaugacaagggcaaaaagguguuaguacuguggggcauccaccaccccucaaccagcgccgaucaacagagucuuuaccagaacgcggacgcauacguuuucguggggacgucucgcuauuccaaaaaguuuaaaccugaaauugccauccgaccaaagguccgugaucaggagggaagaaugaauuacuauuggacuuugguggagcccggugacaaaauaaccuucgaagcuacaggcaaccugguggucccuagguacgccuuugcaauggagcggaacgcugggagcggaauuaucauuucggauacuccaguucaugacugcaauaccacaugucaaaccccgaagggcgccaucaacacgucucuacccuuccagaauauccacccuauuacuauagguaagugcccaaaauaugugaaguccacaaaacuccgccuggcgaccgggcuuagaaacguacccucaauccagaguaggggacuguuuggcgccauugcaggcuucaucgaagggggauggacugguaugguggacggcugguacggguaucaucaccagaaugagcaaggaagcggcuacgcugccgauuugaaguccacacagaacgcuauagacgaaauuaccaauaaagucaacucugugaucgagaagaugaauacgcaguuuaccgccguugguaaggaguucaaccaccucgaaaaacggaucgagaaucugaacaagaaaguggaugacggguucuuagauauuuggacauacaaugcagaacugcucguccuucuggagaacgaacgcacuuuggacuaucaugauagcaaugugaagaaccuauacgagaaaguacgaucacagcugaagaacaaugccaaggagaucggcaacggauguuuugaguucuaucacaaaugcgacaauaccuguauggaaaguguuaagaacggcacauacgauuauccuaaauacuccgaagaggcuaagcucaauagagaagagauugacggggugaaacuggagagcacuaggauauaucaaauccuugcgauuuacucuaccgucgcaucaagucugguguuggucgugagccucggagccaucuccuuuuggaugugcucuaacgguucgcugcagugccggaucuguauuuga

SEQ ID NO: 127154 - RNA, 1701 nt, Artificial Sequence
  derived and/or modified sequence opt3 from hemagglutinin__InfluenzaA__ADI99700
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcgugcaccaccccagcacgagugccgaucaacagucuuuguaccagaacgcugacgccuacgucuucguggggacuucccgcuauagcaagaaauuuaagccugagaucgcgauucgaccaaaagugcgugaucaggagggaagaaugaauuacuauuggacccuggucgaacccggugacaagaucacauucgaggcaacuggcaaccuaguugccccuagguacgcuuuugccauggaacggaacgcagggucgggaauuaucauaucugauaccccagugcaugacugcaauacaaccugucaaacgccgaaaggcgcuauuaacacuucccuccccuuccagaauauccacccuauuacaaucgguaagugcccaaaguauguaaaaucaaccaagcugcgccuugccacugggcugagaaacgugcccaguauccagagcaggggauuguuuggcgcgauugccggcuucauagaagggggauggacagguauggucgacggcugguacggguaucaucaccagaaugaacaaggauccggcuacgcagcugaucucaaaucuacccagaacgccaucgacgagauuacgaauaaggugaacagcguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauucaaauguuaaaaaccuguacgagaagguacgaagucagcucaaaaacaaugcaaaggaaaucggcaacggauguuuugaguucuaucacaagugcgacaauacauguauggaauccgugaaaaacggcacuuacgauuauccuaaguacagcgaggaagccaaacugaauagagaggagaucgacggggucaaacuugaaucuaccaggauuuaucaaauccuggcuauuuacucaacaguggcgaguagcuugguccucgugguuucccugggagcaauaucuuuuuggaugugcucgaacgguagcuuacagugccggaucuguauuuga

SEQ ID NO: 127155 - RNA, 1701 nt, Artificial Sequence; identical to SEQ ID NO: 126334
  derived and/or modified sequence opt3 from hemagglutinin__InfluenzaA__ADI99710

SEQ ID NO: 127156 - RNA, 1701 nt, Artificial Sequence
  derived and/or modified sequence opt3 from hemagglutinin__InfluenzaA__ADI99720
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcguggacaggaggguagaaugaacuacuauuggacccugguggaacccggcgacaagauuacauucgaggccacugggaaucuagucguuagcagguacgcuuuugccauggaacggaacgcaggaucgggcaucauaauuucugauaccccugugcaugacugcaacacaaccugucaaacgccaaaaggugcuaucaauacuucccucccguuccagaacauucaccccaucacaaucgggaagugcccuaaguauguaaaaucaaccaagcugcgccuugccacuggacugagaaaugugccaaguauucagagcaggggcuuguuuggcgcgauagccggguucaucgagggagguuggacaggcauggucgacgggugguacggauaucaucaccagaacgaacaaggcuccgguuacgcagcugaucucaaaucuacccagaaugccauugacgagaucacgaacaaggugaauagcguuauagagaaaaugaacacccaguuuacagcuguggggaaggaguucaaucaccuggagaagcggauugaaaacuuaaauaaaaaggucgaugacggcuuccuggauaucuggacuuacaacgccgagcuccuugugcuguuggaaaaugagcgcacccuagacuaucaugauucaaacguaaagaaucuguacgagaagguucgaagucagcucaaaaacaacgcaaaggaaaucggaaauggcuguuuugaguucuaucacaagugcgacaacacauguauggaauccgugaaaaaugggacuuacgauuaucccaaguacagcgaggaagccaaacugaacagagaggagauugacggagucaaacuugaaucuaccaggaucuaucaaauucuggcuauauacucaacaguggcgaguagcuugguccucgugguuucccugggugcaaucucuuuuuggaugugcucgaauggcagcuuacagugccggauuuguaucuga

SEQ ID NO: 127157 - RNA, 1701 nt, Artificial Sequence; identical to SEQ ID NO: 124685
  derived and/or modified sequence opt3 from hemagglutinin__InfluenzaA__ADI99730

SEQ ID NO: 127158 - RNA, 1701 nt, Artificial Sequence; identical to SEQ ID NO: 124685
  derived and/or modified sequence opt3 from hemagglutinin__InfluenzaA__ADJ00497

SEQ ID NO: 127159 - RNA, 1701 nt, Artificial Sequence; identical to SEQ ID NO: 124685
  derived and/or modified sequence opt3 from hemagglutinin__InfluenzaA__ADJ00498

SEQ ID NO: 127160 - RNA, 1701 nt, Artificial Sequence; identical to SEQ ID NO: 125879
  derived and/or modified sequence opt3 from hemagglutinin__InfluenzaA__ADJ00501

SEQ ID NO: 127161 - RNA, 1701 nt, Artificial Sequence; identical to SEQ ID NO: 125849
  derived and/or modified sequence opt3 from hemagglutinin__InfluenzaA__ADJ18163

SEQ ID NO: 127162 - RNA, 1701 nt, Artificial Sequence; identical to SEQ ID NO: 125849
  derived and/or modified sequence opt3 from hemagglutinin__InfluenzaA__ADJ18165

SEQ ID NO: 127163 - RNA, 1701 nt, Artificial Sequence
  derived and/or modified sequence opt3 from hemagglutinin__InfluenzaA__ADJ18167
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccuuaugcaggggccaaaaguuuuuacaagaaucugaucuggcucgugaaaaagggaaacagcuauccaaaauuaucuaaguccuacauaaaugacaagggcaaagaaguacugguucuuuggggcauccaucaccccucaacgagcgcugaucaacagaguuuguaccagaacgccgacgcguauguguucgucgggacuucucgcuacuccaagaaauuuaagccugagauugcaauccgaccaaaagugcgugauagagagggaaggaugaauuauuacuggacccugguggaacccggugacaagauuacauucgaggccacuggcaaccuagucguuccucgguaugcuuuugccauggaacgcaacgcagggagcggaaucauaauuucggauaccccagugcacgacugcaauacaaccugucagacgccgaaaggcgcuaucaacacuucucuccccuuccaaaauauucauccuaucacaaucgguaagugcccaaaguacguaaaauccaccaagcugagacuugccacugggcugaggaacauucccucaauacagagucggggauuguuuggcgcgaucgccggcuucauugaagggggauggacagguaugguggacggcugguauggguaccaccaucagaaugaacagggaagcggcuacgcagcugaucucaaauccacccaaaacgccaucgacaagauaacgaauaaagucaacucugugauugagaagaugaauacccaguuuacagcuguugguaaggaguucaaccaccuggaaaaacgcaucgagaauuuaaacaagaaaguggaugacggguuccuggauaucuggacuuauaaugccgaacuccuuguccuguuggagaacgaacgaacccuagacuaccacgauagcaaugugaagaaccuguaugagaaaguaagaucacagcucaagaacaaugcaaaggagauuggcaacggauguuuugaguucuaccauaaaugcgacaauacauguauggaaaguguuaagaacggcacuuaugauuacccuaaauauuccgaagaggccaagcugaauagggaagagaucgacggggugaaacuugagagcacccggauuuaccagauacuggcuaucuacucuacagucgcgucaaguuuggugcucgucgugagccugggagcaauuuccuuuuggaugugcucuaacgguucguuacaaugccguaucuguaucuga

SEQ ID NO: 127164 - RNA, 1701 nt, Artificial Sequence
  derived and/or modified sequence opt3 from hemagglutinin__InfluenzaA__ADJ18169
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugaacagggaagcggcuacgcagcugaucucaaauccacccaaaacgccauugacaagaucacgaauaaagugaacucuguuauagagaagaugaauacccaguuuacagcuguggguaaggaguucaaccaccuggaaaaacgcauugagaauuuaaacaagaaagucgaugacggguuccuggauaucuggacuuacaaugccgaacuccuugugcuguuggagaacgaacgaacccuagacuaucaugauagcaauguaaagaaccuguacgagaaaguuagaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagggaagagauugacggggucaaacuugagagcacccggaucuaucagauucuggcuauauacucuacaguggcgucaaguuugguccucgugguuagccugggagcaaucuccuuuuggaugugcucuaacgguucguuacaaugccguauuuguaucuga

SEQ ID NO: 127165 - RNA, 1701 nt, Artificial Sequence
  derived and/or modified sequence opt3 from hemagglutinin__InfluenzaA__ADJ18171
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcuggccauacauuguugagaccuccucuucggacaacggaacuugcuauccgggcgauuuuaucgacuacgaggaacucagggagcagcugucaagcgugaguuccuucgaacgguuugagauuuuccccaagacaucuagcuggccuaaucacgauuccaacaagggugucaccgccgcuuguccacaugcaggggccaaaucauuuuaucaaaaucugaucuggcucgugaagaaaggaaacaguuaccccaaguuaagcaaaucuuauauacacgacaagggcaaggaaguacugguucuuuggggcauccaccauccuuccacgucagcugaucagcagagcuuguaccagaaugccgacgcguacguguucgucgggaccagucgcuauucuaaaaaguuuaaaccagagauugcaauccgacccaaggugcgugauagacaaggaaggaugaacuacuauuggacucugguggagcuaggugacaaaauuacauucgaagccacuggcaaucucgucguuccucgguacgcuuuugccauggagcgcaacgcaggguccggaaucauaauuagcgauaccccagugcacaacugcaauacaaccugucagacgacuacaggcgcuaucaacaccucgcugccguuccagaauauucaucccaucacuaucgguaagugcccuaaauauguaaagucuacaaagcugagacuugccaccggguugaggaacgugccauccauucagucacggggacucuuuggcgcgauagccggcuucaucgaagggggauggacggguauggucgacggcugguacggguaucaccaccaaaaugagcagggaaguggcuacgcagcugaccugaaaagcacccagaacgccauugauaagaucacaaauaaagugaacuccguuauagaaaagaugaauacucaguuuaccgcuguggguaaagaguucaaccauuuagagaagcgcauugaaaaucugaacaagaaagucgacgauggguuccucgacaucuggacauacaaugccgagcuucugguguugcuagaaaacgagcgaacucuggauuaucacgacucuaauguaaagaaccucuacgaaaaaguuagaagccaacugaagaacaaugcaaaagagaucggcaacggauguuuugaguucuaucauaagugcgauaauaccuguauggaaucagugaagaacggcacauacgacuaucccaaauacagugaggaagccaaacuuaauagggaggaaauugauggggucaagcuggaguccacccggaucuaucagauuuuggcuauauacagcacuguggcgucuucacucguccuggugguuaguuuaggagcaaucagcuuuuggaugugcuccaacgguucucugcagugccguauuuguaucuga

SEQ ID NO: 127166 - RNA, 1701 nt, Artificial Sequence; identical to SEQ ID NO: 125849
  derived and/or modified sequence opt3 from hemagglutinin__InfluenzaA__ADJ18173

SEQ ID NO: 127167 - RNA, 1701 nt, Artificial Sequence; identical to SEQ ID NO: 125849
  derived and/or modified sequence opt3 from hemagglutinin__InfluenzaA__ADJ18175

SEQ ID NO: 127168 - RNA, 1701 nt, Artificial Sequence
  derived and/or modified sequence opt3 from hemagglutinin__InfluenzaA__ADJ18177
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacauucccucagugcagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugauaagaucacgaauaaagugaacucuguuauagagaagaugaauacccaguuuacagcuguggggaaggaguucaaccaccuggaaaaacggauugagaauuuaaacaagaaagucgacgauggcuuccuggacaucuggacuuacaaugccgaacuccuugugcuguuggagaacgaacgcacccuagauuaucaugacagcaauguaaagaaccuguacgagaaaguucgaucacagcucaagaacaaugcaaaggagaucggaaacggcuguuuugaguucuaucacaaaugcgauaauacauguauggagagugugaagaacgggacuuacgacuauccuaaauacuccgaagaggccaagcugaauagagaagagauugauggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 127169 - RNA, 1701 nt, Artificial Sequence
  derived and/or modified sequence opt3 from hemagglutinin__InfluenzaA__ADJ40444
augaaggccauccuggugguccuccuuuacaccuucgcuacagcaaacgccgacacucugugcauuggcuaucacgcgaauaacagcacggauaccguugacacaguguugaaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggaacucagggagcagcugagcaguguguccucuuucgagcgguuugaaauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127170 - RNA, 1701 nt, Artificial Sequence
  derived and/or modified sequence opt3 from hemagglutinin__InfluenzaA__ADJ40454
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguaaucaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaccucaaauccacccagaaugccaucgauaagauaacgaacaaagucaauucugugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaccuguacgagaaaguacgaucacagcucaagaauaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgaugggguggagcuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127171 - RNA, 1701 nt, Artificial Sequence
  derived and/or modified sequence opt3 from hemagglutinin__InfluenzaA__ADJ40464
augaaggccauccuggugguccuccuuuacaccuucgcuacagcaaacacugacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuuauccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 127172 - RNA, 1701 nt, Artificial Sequence
  derived and/or modified sequence opt3 from hemagglutinin__InfluenzaA__ADJ40474
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaagacagcucaaaaacaaugcaaaggagaucggcaacggauguuuugaguucuaucacaagugcgauaauacauguauggagucagugaaaaacggcacuuacgacuauccuaaguacagugaagaggccaaacugaauagggaggaaauugauggggucaaacuugaguccacccggaucuaucaaauucuggcuauauacagcacaguggcgucuucauugguccucgugguuagucugggagcaaucagcuuuuggaugugcuccaacgguucuuuacagugccguauuuguaucuga

SEQ ID NO: 127173 - RNA, 1701 nt, Artificial Sequence
  derived and/or modified sequence opt3 from hemagglutinin__InfluenzaA__ADJ40494
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagacgcugaucuggcucgugaaaaagggaaacagcuacccaaaauuaucuaaguccuauauaaaugauaagggcaaagaaguacugguucuuuggggcauccaccaccccucaacuagcgcugaccaacagaguuuguaccagaacgccgaugcguacguguucgucgggaccucucgcuauuccaagaaauuuaagccugagauugcaauccgaccaaaagugcgugaccaggagggaagaaugaauuacuauuggacacugguggaacccggugauaagauuacuuucgaggccaccggcaaccuagucguuccuagguacgcuuuugccauggaacggaaugcagggagcggaaucauaauuucggacacaccagugcaugacugcaacaccacgugucaaacuccgaaaggcgcuaucaacacaucucuccccuuccagaauauucacccuaucaccaucgguaagugcccaaaguauguaaaauccacuaagcugcgccuugccacagggcugagaaacgugcccucaauucagaguaggggauuguuuggcgcgauagccggcuucaucgaagggggauggaccgguauggucgauggcugguacggguaucaucaccagaaugaacaaggaagcggcuacgcagcugaccucaaauccacgcagaacgccauugaugagaucaccaauaaggugaacucuguuauagagaaaaugaauacacaguuuacugcuguggguaaggaguucaaccaccuggaaaagcggauugaaaauuuaaacaaaaaggucgacgauggguuccuggacaucuggaccuacaaugccgagcuccuugugcuguuggaaaacgagcgcacacuagauuaucaugacagcaauguaaagaaccuguacgagaagguucgaucacagcucaaaaauaacgcaaaggaaaucggcaacggauguuuugaguucuaucacaagugcgauaauacuuguauggaaagugugaaaaacggcaccuacgacuauccuaaguacuccgaggaagccaaacugaauagagaggagauugauggggucaaacuugaaagcacaaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 127174 - RNA, 1701 nt, Artificial Sequence
  derived and/or modified sequence opt3 from hemagglutinin__InfluenzaA__ADJ40514
augaaggccgugcuggucguucuccuuuacaccuucgcuacaacuaacgcagacacgcugugcaucggcuaucacgccaauaacagcaccgauacaguggacacuguauuggagaaaaaugugaccgucacacauuccgugaacuuacuggaagauaagcacaaugggaaacuauguaagcucagaggaguugcgccccugcaucuugguaaaugcaacauugcuggcuggauacuggggaauccugagugugaaucuuugucaaccgccaguagcugguccuacaucguggagacuucuucgucagacaacggaacaugcuauccaggcgauuuuauugacuacgaggagcucagggagcagcugagcagugucuccucuuucgaacgguuugagaucuucccgaagaccagcuccuggcccaaucacgauucaaacaagggugugacggcagccuguccucaugcuggggcaaaaaguuuuuauaagaaucugauuuggcucguaaagaagggaaacagcuacccaaaauuaucuaaguccuauaucaaugacaagggcaaagaaguucuggugcuuuggggcauacaccaccccucaacuagcgccgaucaacagaguuuguaccagaacgcugacgccuacgucuucguggggaccucucgcuauuccaagaaauuuaagccugagaucgcgauucgaccaaaagugcguaaucaggagggaagaaugaacuacuauuggacacuggucgaacccggugauaagaucacuuucgaggcaaccggcaaccuaguugugccuagguacgccuuugcuauggaacggaaugccgggagcggaauuaucauaucggacacaccaguacaugauugcaacaccacgugucaaacuccgaaaggcgcaauuaauacaucucuccccuuccagaacauccacccuauuaccaucgguaagugcccaaaguaugugaaauccacuaagcugcgccuugcuacagggcugagaaauguccccucaauccagaguaggggauuguuuggcgccauugcgggcuucauagaagggggauggaccgguaugguggacggcugguacggguaucaucaccagaacgaacaaggaagcggcuacgccgcagaccucaaauccacgcagaaugcuaucgaugagauuaccaacaagguuaauucugugaucgagaaaaugaacacacaguuuacugccgucgguaaggaguucaaucaccuggaaaagcggauagaaaacuuaaauaaaaagguggacgauggguuccuggacauuuggaccuacaacgcugagcuccuuguacuguuggaaaaugagcgcacacuagauuaucaugacagcaacguuaaaaaccuguacgagaaggugcgaucacagcucaaaaauaacgccaaggaaaucggcaauggauguuuugaguucuaucacaagugcgauaacacuuguauggaaagugucaaaaauggcaccuacgacuauccuaaguacuccgaggaagcaaaacugaacagagaggagaucgauggggugaaacuugaaagcacaaggauuuaucaaauccuggccauuuacucuaccgucgcuucaaguuuggugcucguugugagccugggagcgauauccuuuuggaugugcucuaaugguucguuacagugccggaucuguauuuga

SEQ ID NO: 127175 - RNA, 1701 nt, Artificial Sequence; identical to SEQ ID NO: 124685
  derived and/or modified sequence opt3 from hemagglutinin__InfluenzaA__ADJ40524

SEQ ID NO: 127176 - RNA, 1701 nt, Artificial Sequence; identical to SEQ ID NO: 125038
  derived and/or modified sequence opt3 from hemagglutinin__InfluenzaA__ADJ40534

SEQ ID NO: 127177 - RNA, 1701 nt, Artificial Sequence
  derived and/or modified sequence opt3 from hemagglutinin__InfluenzaA__ADJ40554
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaauacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127178 - RNA, 1701 nt, Artificial Sequence; identical to SEQ ID NO: 124685
  derived and/or modified sequence opt3 from hemagglutinin__InfluenzaA__ADJ40564

SEQ ID NO: 127179 - RNA, 1701 nt, Artificial Sequence; identical to SEQ ID NO: 124685
  derived and/or modified sequence opt3 from hemagglutinin__InfluenzaA__ADJ40574

SEQ ID NO: 127180 - RNA, 1701 nt, Artificial Sequence; identical to SEQ ID NO: 126105
  derived and/or modified sequence opt3 from hemagglutinin__InfluenzaA__ADJ40584

SEQ ID NO: 127181 - RNA, 1701 nt, Artificial Sequence; identical to SEQ ID NO: 124685
  derived and/or modified sequence opt3 from hemagglutinin__InfluenzaA__ADJ40594

SEQ ID NO: 127182 - RNA, 1701 nt, Artificial Sequence; identical to SEQ ID NO: 125254
  derived and/or modified sequence opt3 from hemagglutinin__InfluenzaA__ADJ40604

SEQ ID NO: 127183 - RNA, 1701 nt, Artificial Sequence; identical to SEQ ID NO: 125254
  derived and/or modified sequence opt3 from hemagglutinin__InfluenzaA__ADJ40614

SEQ ID NO: 127184 - RNA, 1701 nt, Artificial Sequence; identical to SEQ ID NO: 124685
  derived and/or modified sequence opt3 from hemagglutinin__InfluenzaA__ADJ40634

SEQ ID NO: 127185 - RNA, 1701 nt, Artificial Sequence; identical to SEQ ID NO: 124685
  derived and/or modified sequence opt3 from hemagglutinin__InfluenzaA__ADJ40644

SEQ ID NO: 127186 - RNA, 1701 nt, Artificial Sequence; identical to SEQ ID NO: 124685
  derived and/or modified sequence opt3 from hemagglutinin__InfluenzaA__ADJ40654

SEQ ID NO: 127187 - RNA, 1701 nt, Artificial Sequence; identical to SEQ ID NO: 124685
  derived and/or modified sequence opt3 from hemagglutinin__InfluenzaA__ADJ40664

SEQ ID NO: 127188 - RNA, 1701 nt, Artificial Sequence; identical to SEQ ID NO: 124685
  derived and/or modified sequence opt3 from hemagglutinin__InfluenzaA__ADJ40674

SEQ ID NO: 127189 - RNA, 1701 nt, Artificial Sequence
  derived and/or modified sequence opt3 from hemagglutinin__InfluenzaA__ADJ41816
augaagaccaucauugcccugagcuacauguucugccucguguuugcucagaaccuucccggcaaugacaacuccacagcaacucuguguuuggggcaccaugccgucccuaauggaacguuaguuaaaaccauaacaaacgaucaaaucgaggugacuaaugcgaccgaacugguacagucuucaaguacagguagaauuugcgacagcccacacaggauccuagauggcaagaacuguacccucauugacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuaucaaugaagguuucaacuggacagggguuacccaguccggaggcucuugcacguguaaacgaggcagcaaugacuccuuuuucucacgucugaacuggcucuacgagagugagagcaaguauccaguguuaaaugucacuaugcccaacaaugggaaguuugauaaacuguacauauggggaauccaccauccuucuaccgacaaggaacaaacaaaccuuuauauuagagcuuccgguagggugacuguaucaaccaaacggagccagcagacaguuaucccaaacauuggcagucgccccugggugagaggguugucuuccaggaucagcauauacuggaccauugucaagccuggagauauccugcuaauuucgucuacgggcaaucucaucgcaccacgggguuacuucaaaauccgcacugggaaguccucaauuaugcgaagugacgccccgauaggaacaugcagcuccgaguguaucacccccaacggcucuauuccuaaugacaagccauuucagaacgugaauaaaaucacuuauggcgcuugccccagauacgugaagcaaaacacacugaaacuugccaccgggaugaggaaugucccugaaaagcagacgcggggaauauucggugcgauugcaggcuuuaucgagaacgggugggagggaaugguugauggcugguaugguuuccgucaccagaauagcgaagggaccggccaggccgcugaccugaaaucaacacaagccgcaaucgaucagauuaacggaaaguugaaucgcgugaucgagaaaacuaacgaaaaguuccaccagauugagaaggaauuuagugagguagagggcagaauacaagaccucgaaaaauacguggaggauaccaagaucgaccugugguccuauaaugcugaauuacuggucgcccucgagaaccagcauacaauugaucuuacugacagcgaaaugaauaaacuguucgagaagaccaggaaacaguugcgggagaacgcggaagauauggggaacggauguuuuaagaucuaccacaagugcgacaaugccugcaucgguucuauucgaaacggcacauaugaucaugacguguaccgcgacgaggcacuaaauaacagauuccagauaaaagggguugaacugaagucaggauacaaagauuggauccucuggauuaguuuugcuaucagcuguuuccugcuuugcgugguccuguugggcuuuauuaugugggccugucaaaaggguaauaucaggugcaacauauguaucuga

SEQ ID NO: 127190 - RNA, 1701 nt, Artificial Sequence; identical to SEQ ID NO: 124685
  derived and/or modified sequence opt3 from hemagglutinin__InfluenzaA__ADJ56640

SEQ ID NO: 127191 - RNA, 1701 nt, Artificial Sequence; identical to SEQ ID NO: 125483
  derived and/or modified sequence opt3 from hemagglutinin__InfluenzaA__ADJ56650

SEQ ID NO: 127192 - RNA, 1701 nt, Artificial Sequence; identical to SEQ ID NO: 124776
  derived and/or modified sequence opt3 from hemagglutinin__InfluenzaA__ADJ67983

SEQ ID NO: 127193 - RNA, 1701 nt, Artificial Sequence; identical to SEQ ID NO: 124776
  derived and/or modified sequence opt3 from hemagglutinin__InfluenzaA__ADJ67984

SEQ ID NO: 127194 - RNA, 1701 nt, Artificial Sequence; identical to SEQ ID NO: 124776
  derived and/or modified sequence opt3 from hemagglutinin__InfluenzaA__ADJ67985

SEQ ID NO: 127195 - RNA, 1701 nt, Artificial Sequence
  derived and/or modified sequence opt3 from hemagglutinin__InfluenzaA__ADJ80241
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguaaucaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127196 - RNA, 1701 nt, Artificial Sequence
  derived and/or modified sequence opt3 from hemagglutinin__InfluenzaA__ADJ80242
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacagcggcaucaaguuuggugcucgucgugagccugggagccaucuccuuuuggaugugcucuaacgguucguuacagugccggauuuguaucuga

SEQ ID NO: 127197 - RNA, 1701 nt, Artificial Sequence; identical to SEQ ID NO: 126237
  derived and/or modified sequence opt3 from hemagglutinin__InfluenzaA__ADJ80243

SEQ ID NO: 127198 - RNA, 1701 nt, Artificial Sequence; identical to SEQ ID NO: 124685
  derived and/or modified sequence opt3 from hemagglutinin__InfluenzaA__ADJ80634

SEQ ID NO: 127199 - RNA, 1701 nt, Artificial Sequence; identical to SEQ ID NO: 126687
  derived and/or modified sequence opt3 from hemagglutinin__InfluenzaA__ADJ80644

SEQ ID NO: 127200 - RNA, 1701 nt, Artificial Sequence; identical to SEQ ID NO: 126687
  derived and/or modified sequence opt3 from hemagglutinin__InfluenzaA__ADJ80654

SEQ ID NO: 127201 - RNA, 1701 nt, Artificial Sequence; identical to SEQ ID NO: 125849
  derived and/or modified sequence opt3 from hemagglutinin__InfluenzaA__ADJ80674

SEQ ID NO: 127202 - RNA, 1701 nt, Artificial Sequence; identical to SEQ ID NO: 125849
  derived and/or modified sequence opt3 from hemagglutinin__InfluenzaA__ADJ80684

SEQ ID NO: 127203 - RNA, 1701 nt, Artificial Sequence
  derived and/or modified sequence opt3 from hemagglutinin__InfluenzaA__ADJ80694
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaaucacaacgggaagcuguguaaacuaagaggaguggcuccccuccaucuggguaagugcaauaucgccggcuggauucuugggaacccugagugugaaucucugucaacagcaaguagcugguccuacaucguugagaccucuucgucagacaauggaacuugcuauccaggcgauuuuauugacuacgaagaguugagggagcagcucagcaguguguccucuuucgaacgguuugagaucuucccgaaaacaagcuccuggcccaaccacgauucaaauaagggugucaccgccgcuuguccucaugcaggggccaagaguuuuuauaaaaaccugauauggcuggugaagaaaggaaauagcuacccaaagcucucuaaauccuauaucaacgacaagggcaaggaaguauuaguucuguggggcauucaccaccccucaacgagcgcugaucaacagagucuuuaccagaaugccgacgcguacguguucgucgggucuucccgcuauagcaaaaaguuuaaaccugagaucgcaauucgaccaaaggugcgugaucaggagggaagaaugaacuacuauuggacuuugguggaacccggugacaaaaucaccuucgaggccacaggcaaccuggucguuccuagguacgcuuuugccauggaacggaaugcagggucgggaauaauuaucucugauacuccagugcaugacugcaacaccacaugucaaaccccgaagggcgcuauuaauacgucccuacccuuccagaacauccacccuaucacuauugguaaaugcccaaaguauguaaagucaacaaaacuccgccuggccaccgggcuuagaaaugugcccaguauacagagcaggggacuguuuggcgcgaucgccggcuucauugaagggggauggacugguauggucgacggcugguacggguaucaucaccagaacgaacaaggauccggcuacgcagcugauuugaagucuacacagaaugccaucgacgagauaaccaacaaagugaauagcguuauugagaagaugaacacgcaguuuaccgcuguggguaaagaguucaaucaccucgagaagcggaucgaaaaccugaauaagaaagucgaugacggguucuuagauaucuggacauacaacgccgagcugcucgugcuucuggaaaaugagcgcacuuuggacuaucaugauucaaacguaaagaaccuauacgagaaaguucgaagucagcugaagaauaacgcaaaagaagugggcaauggauguuuugaguucuaucacaagugcgacaacaccuguauggaauccgucaagaauggcacauacgauuauccuaaauacagcgaggaagccaagcucaacagagaggagauugacggggugaaacuggaaucuacuaggaucuaucaaauucuugcuauauacucaaccgcggcaaguagccuggucuuggugguuucccucggagccaucucuuuuuggaugugcucgaaugguagccugcagugccggauuuguaucuga

SEQ ID NO: 127204 - RNA, 1701 nt, Artificial Sequence; identical to SEQ ID NO: 125849
  derived and/or modified sequence opt3 from hemagglutinin__InfluenzaA__ADJ80704

SEQ ID NO: 127205 - RNA, 1701 nt, Artificial Sequence
  derived and/or modified sequence opt3 from hemagglutinin__InfluenzaA__ADJ80714
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagcugcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 127206 - RNA, 1701 nt, Artificial Sequence; identical to SEQ ID NO: 124685
  derived and/or modified sequence opt3 from hemagglutinin__InfluenzaA__ADJ80724

SEQ ID NO: 127207 - RNA, 1701 nt, Artificial Sequence; identical to SEQ ID NO: 125849
  derived and/or modified sequence opt3 from hemagglutinin__InfluenzaA__ADJ80734

SEQ ID NO: 127208 - RNA, 1701 nt, Artificial Sequence; identical to SEQ ID NO: 125849
  derived and/or modified sequence opt3 from hemagglutinin__InfluenzaA__ADJ80744

SEQ ID NO: 127209 - RNA, 1701 nt, Artificial Sequence; identical to SEQ ID NO: 125849
  derived and/or modified sequence opt3 from hemagglutinin__InfluenzaA__ADJ80754

SEQ ID NO: 127210 - RNA, 1701 nt, Artificial Sequence
  derived and/or modified sequence opt3 from hemagglutinin__InfluenzaA__ADJ80774
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaacaguuggagcuacaucguugagaccuccucuucggacaauggaacuugcuauccaggcgauuuuauugacuacgaagaguugagggagcagcucucaagcgugaguuccuucgaacgguuugagaucuucccgaagacaucuagcuggcccaaccacgauuccaauaagggugucaccgccgcuuguccucaugcaggggccaaaucauuuuauaagaaccugauauggcuggugaaaaagggaaauaguuacccaaaacucagcaagucuuauaucaacgacaagggcaaagaaguauuaguucuguggggcauucaccaccccuccacgucagcugaucaacagagccuuuaccagaaugccgacgcguacguguucgucgggaguucucgcuauuccaagaaauuuaagccugagaucgcaauucgaccaaaagugcgugaucaggagggaagaaugaacuacuauuggacuuugguggaacccggugacaagaucaccuucgaggccacaggcaaccuggucguuccuagguacgcuuuugccauggaacggaaugcagggagcggaauaauuaucucggauacuccagugcaugacugcaacaccacaugucaaaccccgaaaggcgcuauuaauacgucucuacccuuccagaacauccacccuaucacuauugguaagugcccaaaguauguaaaauccacaaagcuccgccuggccaccgggcuuagaaaugugcccucaauacagaguaggggacuguuuggcgcgaucgccggcuucauugaagggggauggacugguauggucgacggcugguacggguaucaucaccagaacgaacaaggaagcggcuacgcagcugauuugaaauccacacagaaugccaucgacgagauaaccaacaagguaaauucuguuauugagaaaaugaacacgcaguuuaccgcuguggguaaggaguucaaucaccucgagaagcggaucgaaaaccugaauaaaaaggucgaugacggguucuuagauaucuggacauacaacgccgagcugcucgugcuucuggaaaaugagcgcacuuuggacuaucaugauagcaacgugaaaaaccuauacgagaagguucgaucacagcugaaaaauaacgcaaaggaagugggcaauggauguuuugaguucuaucacaagugcgacaacaccuguauggaaagugucaaaaauggcacauacgauuauccuaaguacuccgaggaagccaaacucaacagagaggagauugacggggugaagcuggaaagcacuaggaucuaucaaauucuugcuauauacucuaccgcggcaucaagucuggucuuggugguuagccucggagccaucuccuuuuggaugugcucuaaugguucgcugcagugccggauuuguaucuga

SEQ ID NO: 127211 - RNA, 1701 nt, Artificial Sequence
  derived and/or modified sequence opt3 from hemagglutinin__InfluenzaA__ADJ80784
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccacaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaccagaaugaacagggaagcggcuacgcagcugaucucaaauccacccaaaacgccauugacaagaucacgaauaaagugaacucuguuauagagaagaugaauacccaguuuacagcuguggguaaggaguucaaccaucuggaaaaacggauugagaauuuaaacaagaaagucgaugacggguuccuggauaucuggacuuacaaugccgaacuccuugugcuguuggagaacgaacgcacccuagacuaucacgauagcaauguaaagaaccuguacgagaaaguucgaucacagcucaagaacaaugcaaaggagaucggcaacggauguuuugaguucuaucauaaaugcgacaauacauguauggaaagugugaagaacggcacuuacgauuauccuaaauacuccgaagaggccaagcugaauagagaagagauugacggggucaaacuugagagcaccaggaucuaucagauucuggcuauauacucuacaguggcgucaaguuugguccucgugguuagccugggagcaaucuccuuuuggaugugcucuaacgguucguuacaaugccggauuuguaucuga

SEQ ID NO: 127212 - RNA, 1701 nt, Artificial Sequence; identical to SEQ ID NO: 125849
  derived and/or modified sequence opt3 from hemagglutinin__InfluenzaA__ADJ80794

SEQ ID NO: 127213 - RNA, 1701 nt, Artificial Sequence; identical to SEQ ID NO: 126687
  derived and/or modified sequence opt3 from hemagglutinin__InfluenzaA__ADJ80804

SEQ ID NO: 127214 - RNA, 1701 nt, Artificial Sequence
  derived and/or modified sequence opt3 from hemagglutinin__InfluenzaA__ADJ80814
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucgcgcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucaacagaguuuguaccagaacgccgacgcguacguguucgucgggacuucucgauauuccaagaaauuuaagccugagauugcaauccguccaaaagugagagaucaggagggaaggaugaauuacuauuggacccugguggaacccggugacaagauuacauucgaggccacuggcaaccuagucguuccucgguacgcuuuugccaucgaacgcaacgcagggagcggaauaauuaucucggauaccccagugcacgacugcaauacaaccugucaaacgccgaaaggcgcuauuaacacuucucuccccuuccagaauauccauccuaucacaauugguaagugcccaaaguauguaaaauccaccaagcugagacuugccacugggcugaggaacgugcccucaauacagagucggggauuguuuggcgcgaucgccggcuucauugaagggggauggacagguauggucgacggcugguacggguaucaccaucagaaugaacaaggaagcggcuacgcagcugaucucaaauccacccagaacgccaucgacaagauaacgaauaaagugaacucuguuauugagaagaugaauacccaguuuacagcuguggguaaggaguucaaccaccuggaaaaacgcaucgagaauuuaaacaagaaagucgaugacggguuccuggauaucuggacuuacaaugccgaacuccuugugcuguuggagaacgaacgaacccuagacuaucacgauagcaauguaaagaaccuguacgagaaaguuagaucacagcucaagaacaaugcaaaggagauuggcaacggauguuuugaguucuaucauaaaugcgacaauacauguauggaaagugugaagaacggcacuuacgauuauccuaaauacuccgaagaggccaagcugaauagggaagagaucgacggggucaaacuugagagcacccggauuuaucaaauacuggcuaucuacucuacaguggcgucaaguuugguccucgugguuagccugggagcaauuuccuuuuggaugugcucuaacgguucguuacagugccguaucuguaucuga

SEQ ID NO: 127215 - RNA, 1701 nt, Artificial Sequence
  derived and/or modified sequence opt3 from hemagglutinin__InfluenzaA__ADJ80834
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacagcgggucgggaaucauaauuucugauacaccagugcauuauugcaauaccacgugucaaacuccgaaaggcgccaucaacacaucccuccccuuccagaauauucacccuaucaccaucgguaagugcccaaaguacguaaaaucaacuaagcugcgccuugcaacagggcugagaaacgugcccaguauucagagcaggggauuguuuggcgcuauagccggcuucaucgaagggggauggaccgguauggucgacggcugguauggguaccaucaccagaaugaacaaggauccggcuacgcggccgaccucaaaucuacgcagaacgcaauugaugagaucaccaauaaggugaacagcguuauagagaaaaugaauacacaguuuacugcuguggguaaggaguucaaccaccuggaaaagcggauugaaaauuuaaacaaaaaggucgacgauggguuccuggacaucuggaccuauaaugccgagcuccuugugcuguuggaaaacgagcgcacacuagauuaccaugacucaaauguaaagaaccuguaugagaagguucgaagucagcucaaaaacaaugcuaaggaaaucggcaacggauguuuugaguucuaccacaagugcgauaauacuuguauggaauccgugaaaaacggcaccuaugacuacccuaaguauagcgaggaagccaaacugaauagagaggagauugauggggucaaacuugaaucuacaaggaucuaccaaauucuggcaauauacucaaccguggccaguagcuugguccucgugguuucccugggagcuaucucuuuuuggaugugcucgaacgguagcuuacagugccggauuuguaucuga

SEQ ID NO: 127216 - RNA, 1701 nt, Artificial Sequence; identical to SEQ ID NO: 126887
  derived and/or modified sequence opt3 from hemagglutinin__InfluenzaA__ADJ80848

SEQ ID NO: 127217 - RNA, 1701 nt, Artificial Sequence
  derived and/or modified sequence opt3 from hemagglutinin__InfluenzaA__ADJ80858
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 127218 - RNA, 1701 nt, Artificial Sequence
  derived and/or modified sequence opt3 from hemagglutinin__InfluenzaA__ADJ80868
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccuaaugcaggggccaaaaguuuuuauaagaaccugaucuggcucgugaaaaagggaaauagcuacccaaaauuaucuaaguccuauauaaacgacaagggcaaagaaguacugguucuuuggggcauccaucaccccucaacgagcgcugaucaacagaguuuguaccagaaugccgacgcguacguguucgucgggacuucucgcuauuccaagaaauuuaagccugagauugcaauccgaccaaaagugcgugaucaggagggaagaaugaacuacuauuggacccugguggaacccgguggcaagauuacauucgaggccacugggaaccuagucguuccuagguacgcuuuugccauggaacggaaugcaggaagcggcaucauaauuucggacaccccagugcacgauugcaacacaaccugucaaacgccgaaaggugcuaucaauacuucucuccccuuccagaacauucauccuaucacaaucgggaagugcccaaaguauguaaaauccaccaagcugcgccuugccacuggacugagaaaugugcccucaauucagaguaggggcuuguuuggcgcgauagccggguucaucgagggagguuggacaggcauggucgacgggugguacggauaucaccaucagaacgaacaaggcagcgguuacgcagcugaccucaaauccacccagaaugccauugauaagaucacgaacaaaguuaauucugugauagagaagaugaacacccaguuuacagcuguggggaaggaguucaaucaccuggaaaaacggauugagaacuuaaauaagaaagucgacgauggcuuccuggacaucuggacuuacaacgccgaacuccuugugcuguuggagaaugaacgcacccuagauuaucacgacagcaacguaaagaaccuguacgagaaaguucgaucacagcucaagaauaacgcaaaggagaucggaaauggcuguuuugaguucuaucauaaaugcgauaacacauguauggagagugugaagaaugggacuuacgacuauccuaaauacuccgaagaggccaagcugaacagagaagagauugauggagucaaacuugagagcaccaggaucuaucaaauucuggcuauauacucuacaguggcgucaaguuugguccucgugguuagccugggugcaaucuccuuuuggaugugcucuaauggcucguuacagugccggauuuguaucuga

SEQ ID NO: 127219 - RNA, 1701 nt, Artificial Sequence; identical to SEQ ID NO: 125849
  derived and/or modified sequence opt3 from hemagglutinin__InfluenzaA__ADJ80883

SEQ ID NO: 127220 - RNA, 1701 nt, Artificial Sequence; identical to SEQ ID NO: 125849
  derived and/or modified sequence opt3 from hemagglutinin__InfluenzaA__ADJ80893

SEQ ID NO: 127221 - RNA, 1701 nt, Artificial Sequence; identical to SEQ ID NO: 125849
  derived and/or modified sequence opt3 from hemagglutinin__InfluenzaA__ADJ80910

SEQ ID NO: 127222 - RNA, 1701 nt, Artificial Sequence; identical to SEQ ID NO: 124685
  derived and/or modified sequence opt3 from hemagglutinin__InfluenzaA__ADJ80927

SEQ ID NO: 127223 - RNA, 1701 nt, Artificial Sequence
  derived and/or modified sequence opt3 from hemagglutinin__InfluenzaA__ADJ80937
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacgcauucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucauaauugcaacacaaccugucaaacgccgaaaggcgccaucaauacuucucuccccuuccagaacauucacccuaucacaaucgguaagugcccaaaguaugugaaauccaccaagcugcgccuugcgacugggcugagaaauguacccucaauucagaguaggggauuguuuggcgccauagcaggcuucaucgaagggggauggacagguaugguggacggcugguacggguaucaucaccagaacgaacaaggaagcggcuacgcugccgaccucaaauccacccagaaugcuauugaugagaucacgaacaaggucaauucugugauagagaaaaugaacacccaguuuacagccguugguaaggaguucaaucaccuggaaaagcggauugaaaacuuaaauaaaaagguggacgauggguuccuggacaucuggacuuacaacgcagagcuccuuguccuguuggaaaaugagcgcacccuagauuaucaugacagcaacgugaaaucacuguacgagaagguacgaagucagcucaaaaacaaugccaaggaaaucggcaacggauguuuugaguucuaucacaagugcgauaauacauguauggaauccguuaaaaacggcacuuacgacuauccuaaguacagcgaggaagcuaaacugaauagagaggagauugauggggugaaacuugaaucuaccaggaucuaucaaauucuggcgauauacucaacagucgcaaguagcuuggugcucgucgugucccugggagccaucucuuuuuggaugugcucgaacgguagcuuacagugccggauuuguaucuga

SEQ ID NO: 127224 - RNA, 1701 nt, Artificial Sequence; identical to SEQ ID NO: 125849
  derived and/or modified sequence opt3 from hemagglutinin__InfluenzaA__ADJ80947

SEQ ID NO: 127225 - RNA, 1701 nt, Artificial Sequence; identical to SEQ ID NO: 125849
  derived and/or modified sequence opt3 from hemagglutinin__InfluenzaA__ADJ80967

SEQ ID NO: 127226 - RNA, 1701 nt, Artificial Sequence; identical to SEQ ID NO: 125849
  derived and/or modified sequence opt3 from hemagglutinin__InfluenzaA__ADJ80977

SEQ ID NO: 127227 - RNA, 1701 nt, Artificial Sequence
  derived and/or modified sequence opt3 from hemagglutinin__InfluenzaA__ADJ80993
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccuaaugcaggggccaaaaguuuuuauaagaaccugaucuggcucgugaaaaagggaaauagcuacccaaaauuaucuaaguccuauauaaacgacaagggcaaagaaguacugguucuuuggggcauccaucaccccucaacgagcgcugaucaacagaguuuguaccagaaugccgacgcguacguguucgucgggacuucucgcuauuccaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcagggagcggaaucauaauuucggauaccccagugcacgacugcaacacaaccugucaaacgccgaaaggcgcuaucaauacuucucuccccuuccagaacauucauccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaccaucagaacgaacaaggaagcggcuacgcagcugaucucaaauccacccagaaugccauugacaagaucacgaacaaaguuaauucugugauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucacgauagcaacguaaagaaccuguacgagaaaguucgaucacagcucaagaauaacgcaaaggagaucggcaauggauguuuugaguucuaucauaaaugcgacaacacauguauggaaagugugaagaauggcacuuacgauuauccuaaauacuccgaagaggccaagcugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127228 - RNA, 1701 nt, Artificial Sequence
  derived and/or modified sequence opt3 from hemagglutinin__InfluenzaA__ADJ81003
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaaaagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127229 - RNA, 1701 nt, Artificial Sequence; identical to SEQ ID NO: 126887
  derived and/or modified sequence opt3 from hemagglutinin__InfluenzaA__ADJ81013

SEQ ID NO: 127230 - RNA, 1701 nt, Artificial Sequence
  derived and/or modified sequence opt3 from hemagglutinin__InfluenzaA__ADJ81023
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaaauaagucuuauaucaacgacaagggcaaagaaguacugguucuuuggggcauacaccaccccuccacgucagcugaucaacagagcuuguaccagaaugccgacgcguacguguucgucgggacuagccgcuauucuaagaaauuuaagccugagaucgcaauucgaccaaaagugcgugaucaggagggaagaaugaacuacuauuggacccugguggaacccggugacaagaucacauucgaggccacuggcaaccuagucguuccuagguacgcuuuugccauggaacggaaugcaggguccggaauuaucauaagcgauaccccagugcaugacugcaacacaaccugucaaacgccgaaaggcgcuauuaauacuucgcuccccuuccagaacauccacccuauuacaaucgguaagugcccaaaguauguaaaaucuaccaagcugcgccuugccacugggcugagaaaugugcccuccauccagucaaggggauuguuuggcgcgauugccggcuucauagaagggggauggacagguauggucgacggcugguacggguaucaucaccagaacgaacaaggaaguggcuacgcagcugaucucaaaagcacccagaaugccaucgacgagauuacgaacaagguaaauuccguuaucgagaaaaugaacacccaguuuacagcuguggguaaggaguucaaucaccuggaaaagcggauagaaaacuuaaauaaaaaggucgaugacggguuccuggauauuuggacuuacaacgccgagcuccuugugcuguuggaaaaugagcgcacccuagacuaucaugauucuaacgugaaaaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagaucgacggggucaaacuugaauccaccaggauuuaucaaauccuggcuauuuacagcacaguggcgucuucauugguccucgugguuagucugggagcaauaaguuuuuggaugugcuccaaugguucuuuacagugccggaucuguauuuga

SEQ ID NO: 127231 - RNA, 1701 nt, Artificial Sequence; identical to SEQ ID NO: 125849
  derived and/or modified sequence opt3 from hemagglutinin__InfluenzaA__ADJ81033

SEQ ID NO: 127232 - RNA, 1701 nt, Artificial Sequence; identical to SEQ ID NO: 124685
  derived and/or modified sequence opt3 from hemagglutinin__InfluenzaA__ADJ81043

SEQ ID NO: 127233 - RNA, 1701 nt, Artificial Sequence
  derived and/or modified sequence opt3 from hemagglutinin__InfluenzaA__ADJ81053
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 127234 - RNA, 1701 nt, Artificial Sequence; identical to SEQ ID NO: 125849
  derived and/or modified sequence opt3 from hemagglutinin__InfluenzaA__ADJ81063

SEQ ID NO: 127235 - RNA, 1701 nt, Artificial Sequence; identical to SEQ ID NO: 125629
  derived and/or modified sequence opt3 from hemagglutinin__InfluenzaA__ADJ84772

SEQ ID NO: 127236 - RNA, 1701 nt, Artificial Sequence
  derived and/or modified sequence opt3 from hemagglutinin__InfluenzaA__ADJ88782
augaagaccaucauugcccugagcuacaugcucugccuuguguucgcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacaggugagaucugcgacagcccacaccagauucuagauggcgaaaauuguacccucaucgacgcucugcuuggggauccgcagugcgacggauuucaaaacaaaaagugggaucuguucguggagagauccaaagccuauucuaauuguuaccccuaugacgucccugauuacgcaucguugaggucacucauagccagcaguggcacucuggaauuuaacaaugaguccuucaacuggacaggugugacccagaaugggacgucuagcgcuugcauccggcgcuccaacaauucauuuuucagucgacugaacuggcucacucauuuaaaguuuaaguauccagcacugaauguuaccaugcccaacaacgagcaguucgacaaacuuuacauuuggggagugcaccauccuggcacagauaaugaccagaucuuuuuguaugcccaagcuagcggccguauuacugucucuaccaagagaucccagcagacagugaucccaaacauagggucaaggccccggguacgcaauauuccuagcagaaucaguauuuacuggaccaucguuaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugugaaccgaaucacauauggugcauguccuagauacgucaaacaaaauacccugaagcuggccacugggaugaggaacgugccagagaaacagacacggggaaucuucggcgcuauugccggcuuuaucgaaaaugggugggagggaaugguggaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgaggucgaagggaggauccaagaccuggagaaguacguugaggauaccaaaaucgacuuauggucuuauaaugccgaacugcucguggcacuugagaaccagcauacaauugaucugacugacagcgaaaugaauaaguuguucgagaaaaccaagaaacagcuaggcgaaaacgcugaggauaugggaaauggcugcuuuaagauauaccacaagugugacaacgccugcaucgggucaauucggaauggaacauaugaucaugacguauaccgagacgaggcucugaacaaucgcuuccagaucaaagguguggaacucaagaguggcuacaaagauuggauucuguggaucuccuuugccauaagcugcuuccuucugugugucgcauugcucggguuuaucaugugggccugccaaaagggaaacauuagauguaauaucugcauuuga

SEQ ID NO: 127237 - RNA, 1701 nt, Artificial Sequence
  derived and/or modified sequence opt3 from hemagglutinin__InfluenzaA__ADK21733
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagcacaugacugcaauaccacgugucaaacuccgaaaggcgcuaucaacacaucucuccccuuccagaauauucacccuaucaccaucgguaagugcccaaaguaugugaaauccacuaagcugcgccuugccacagggcugagaaacguacccucaauucagaguaggggauuguuuggcgcgauagccggcuucaucgaagggggauggaccgguaugguggacggcugguacggguaucaucaccagaaugaacaaggaagcggcuacgcagcugaucucaaauccacgcagaacgccauugacaagaucaccaauaaagucaacucugugauagagaagaugaauacacaguuuacugcuguugguaaggaguucaaccaccuggaaaaacggauugagaauuuaaacaagaaaguggaugacggguuccuggauaucuggaccuacaaugccgaacuccuuguccuguuggagaacgaacgcacacuagacuaucaugauagcaaugugaagaaccuguacgagaaaguacgaucacagcucaagaacaaugcaaaggagaucggcaacggauguuuugaguucuaucacaaaugcgacaauacuuguauggaaaguguuaagaacggcaccuacgauuauccuaaauacuccgaagaggccaagcugaauagagaagagauugacggggugaaacuugagagcacaaggaucuaucaaauucuggcuauauacucuaccgucgcgucaaguuuggugcucgucgugagccugggagcaaucuccuuuuggaugugcucuaacgguucguuacagugccggauuuguaucuga

SEQ ID NO: 127238 - RNA, 1701 nt, Artificial Sequence
  derived and/or modified sequence opt3 from hemagglutinin__InfluenzaA__ADK21743
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaaauaucuaauuccuauaucaacgacaagggcaaggaaguauuaguucuguggggcauucaccaccccucaacgagcgcugaucaacagagucuuuaccagaaugccgacgcguacguguucgucgggacuucucgcuauuccaaaaaguuuaaaccugagaucgcaauucgaccaaaggugcgugaucaggagggaagaaugaacuacuauuggaccuugguggaacccggugacaaaaucacauucgaggccacuggcaaccuggucguuccuagguacgcuuuugccauggaacggaaugcagggagcggaauaauuaucucggauaccccagcucaugacugcaacacaaccugucaaacgccgaagggcgccauuaauacuucucuacccuuccagaacauccacccuaucacaauugguaaaugcccaaaguaugugaaguccaccaaacuccgccuggcgacugggcuuagaaauguacccucaauacagaguaggggacuguuuggcgccaucgcaggcuucauugaagggggauggacagguaugguggacggcugguacggguaucaucaccagaacgaacaaggaagcggcuacgcugccgauuugaaguccacccagaaugcuaucgacgagauaacgaacaaagucaauucugugauugagaagaugaacacccaguuuacagccguugguaaagaguucaaucaccucgaaaagcggaucgaaaaccugaauaagaaaguggaugacggguucuuagauaucuggacuuacaacgcagagcugcucguccuucuggaaaaugagcgcaccuuggacuaucaugauagcaacgugaagaaccuauacgagaaaguacgaucacagcugaagaauaacgccaaagaaauuggcaauggauguuuugaguucuaucacaagugcgacaacacauguauggaaaguguuaagaauggcacuuacgauuauccuaaauacuccgaggaagcuaagcucaacagagaggagaucgacggggugaaacuggaaagcaccaggauuuaucaaauacuugcgaucuacucuacagucgcaucaagucugguguuggucgugagccucggagccauuuccuuuuggaugugcucuaaugguucgcugcagugccggaucuguaucuga

SEQ ID NO: 127239 - RNA, 1701 nt, Artificial Sequence
  derived and/or modified sequence opt3 from hemagglutinin__InfluenzaA__ADK21753
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaagggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaucucaaauccacccagaacgccauugacaagaucacgaauaaagugaacucuguuauagagaagaugaauacccaguuuacagcuguggggaaggaguucaaccaccuggagaaaaggauugagaauuuaaacaagaaagucgaugacggcuuccuggauaucuggacuuacaaugccgaacuccuugugcuguuggagaacgaacggacccuagacuaucaugauagcaauguaaagaaccuguacgagaaaguucgcucacagcucaagaacaaugcaaaggagaucggaaacggcuguuuugaguucuaucacaaaugcgacaauacauguauggaaagugugaagaacgggacuuacgauuauccuaaauacuccgaagaggccaagcugaaucgagaagagauugacggagucaaacuugagagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 127240 - RNA, 1701 nt, Artificial Sequence
  derived and/or modified sequence opt3 from hemagglutinin__InfluenzaA__ADK21763
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuucgaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 127241 - RNA, 1701 nt, Artificial Sequence; identical to SEQ ID NO: 125849
  derived and/or modified sequence opt3 from hemagglutinin__InfluenzaA__ADK21773

SEQ ID NO: 127242 - RNA, 1701 nt, Artificial Sequence; identical to SEQ ID NO: 125849
  derived and/or modified sequence opt3 from hemagglutinin__InfluenzaA__ADK21783

SEQ ID NO: 127243 - RNA, 1701 nt, Artificial Sequence; identical to SEQ ID NO: 124685
  derived and/or modified sequence opt3 from hemagglutinin__InfluenzaA__ADK21813

SEQ ID NO: 127244 - RNA, 1701 nt, Artificial Sequence; identical to SEQ ID NO: 126105
  derived and/or modified sequence opt3 from hemagglutinin__InfluenzaA__ADK21823

SEQ ID NO: 127245 - RNA, 1701 nt, Artificial Sequence
  derived and/or modified sequence opt3 from hemagglutinin__InfluenzaA__ADK21833
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcgcgacugcaauacaaccugucaaacgccgaaaggcgcuaucaacacuucucuccccuuccagaauauucauccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaccaucagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcgcauugaaaauuuaaacaaaaaggucgaugacggguuccuggauaucuggacuuacaaugccgagcuccuugugcuguuggaaaacgagcgaacccuagacuaucacgauagcaauguaaagaaccuguacgagaagguuagaucacagcucaaaaacaaugcaaaggaaaucggcaacggauguuuugaguucuaucauaagugcgacaauacauguauggaaagugugaaaaacggcacuuacgauuauccuaaguacuccgaggaagccaaacugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 127246 - RNA, 1701 nt, Artificial Sequence; identical to SEQ ID NO: 125849
  derived and/or modified sequence opt3 from hemagglutinin__InfluenzaA__ADK21843

SEQ ID NO: 127247 - RNA, 1701 nt, Artificial Sequence; identical to SEQ ID NO: 125038
  derived and/or modified sequence opt3 from hemagglutinin__InfluenzaA__ADK21853

SEQ ID NO: 127248 - RNA, 1701 nt, Artificial Sequence; identical to SEQ ID NO: 126334
  derived and/or modified sequence opt3 from hemagglutinin__InfluenzaA__ADK21863

SEQ ID NO: 127249 - RNA, 1701 nt, Artificial Sequence; identical to SEQ ID NO: 125132
  derived and/or modified sequence opt3 from hemagglutinin__InfluenzaA__ADK21873

SEQ ID NO: 127250 - RNA, 1701 nt, Artificial Sequence
  derived and/or modified sequence opt3 from hemagglutinin__InfluenzaA__ADK21883
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuaaauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacauucccucaauacagaguagaggauuguuuggcgcgaucgccggcuucauugaagggggauggacagguaugguggacggcugguacggguaucaucaccagaaugaacaaggaagcggcuacgcagcugaucucaaguccacccagaacgccaucgacgagauaacgaauaaagucaacucugugauugagaagaugaauacccaguuuacagcuguugguaaggaauuuaaccaccuggagaaaaggaucgaaaauuuaaacaagaaaguggaugacggguuccuggauaucuggacuuacaaugccgagcuccuuguccuguuggaaaacgagcggacccuagacuaucaugauagcaaugugaagaaccuguacgagaaaguacgcucacagcucaagaacaaugcaaaggaaauuggcaacggauguuucgaguucuaucacaaaugcgacaauacauguauggaaaguguuaagaacggcacuuacgauuauccuaaauacuccgaggaagccaagcugaaucgagaggagaucgacggggugaaacuugaaagcaccagaauuuaucaaauacuggcuaucuacucuacagucgcgucaaguuuggugcucgucgugagccugggagcaauuuccuuuuggaugugcucuaacgguucguuacagugcaggaucuguaucuga

SEQ ID NO: 127251 - RNA, 1701 nt, Artificial Sequence; identical to SEQ ID NO: 124685
  derived and/or modified sequence opt3 from hemagglutinin__InfluenzaA__ADK21893

SEQ ID NO: 127252 - RNA, 1701 nt, Artificial Sequence; identical to SEQ ID NO: 126282
  derived and/or modified sequence opt3 from hemagglutinin__InfluenzaA__ADK21903

SEQ ID NO: 127253 - RNA, 1701 nt, Artificial Sequence; identical to SEQ ID NO: 126395
  derived and/or modified sequence opt3 from hemagglutinin__InfluenzaA__ADK21913

SEQ ID NO: 127254 - RNA, 1701 nt, Artificial Sequence
  derived and/or modified sequence opt3 from hemagglutinin__InfluenzaA__ADK21923
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguaaagaaccuauacgagaaagcacgaucacagcugaaaaacaaugccaaggaaauuggcaacggauguuuugaguucuaucacaagugcgacaauacauguauggaaaguguuaaaaacggcacuuacgauuauccuaaguacuccgaggaagcuaaacucaauagagagaagaucgacggggugaaacuggagagcaccaggauuuaucaaauacuugcgaucuacucuacagucgcaucaacccugguguuggucgugagucucggagccauuagcuuuuggaugugcuccaacgguucucugcagugccggaucuguaucuga

SEQ ID NO: 127255 - RNA, 1701 nt, Artificial Sequence
  derived and/or modified sequence opt3 from hemagglutinin__InfluenzaA__ADK21933
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccuaacgcaggggccaaaaguuuuuauaagaaucugaucuggcucgugaaaaagggaaacagcuacccaaaauuaucuaaguccuauauaaaugauaagggcaaagaaguacugguucuuuggggcauccaucaccccucaacgagcgcugaccaacagaguuuguaccagaacgccgaugcguacguguucgucgggacuucucgcuauuccaagaaauuuaagccugagauugcaauccgaccaaaagugcgugaccaggagggaagaaugaauuacuauuggacccugguggaacccggugauaagauuacauucgaggccacuggcaaccuagucguuccuagguacgcuuuugccauggaacggaacgcagggagcggaaucauaauuucggacaccccagugcacgacugcaauacaaccugucaaacgccgaaaggcgcuaucaacacuucucuccccuuccagaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgauggcugguacggguaucaccaucagaaugaacaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugaaaauuuaaacaaaaaggucgacgauggguuccuggacaucuggacuuacaaugccgagcuccuugugcuguuggaaaacgagcgcacccuagauuaucacgacagcaauguaaagaaccuguacgagaagguucgaucacagcucaaaaacaaugcaaaggaaaucggcaacggauguuuugaguucuaucauaagugcgauaauacauguauggaaagugugaaaaacggcacuuacgacuauccuaaguacuccgaggaagccaaacugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127256 - RNA, 1701 nt, Artificial Sequence; identical to SEQ ID NO: 124685
  derived and/or modified sequence opt3 from hemagglutinin__InfluenzaA__ADK21943

SEQ ID NO: 127257 - RNA, 1701 nt, Artificial Sequence
  derived and/or modified sequence opt3 from hemagglutinin__InfluenzaA__ADK21953
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgaccacgaagaacucagggagcagcugagcaguguguccucuuucgaacgguuugagauuuucccgaagacaagcuccuggcccaaucaugauucaaacaagggugucaccgccgcuuguccucacgcaggggccaaaaguuuuuacaagaaucugaucuggcucgugaaaaagggaaacagcuauccaaaauuaucuaaguccuacauaaaugacaagggcaaagaaguacugguucuuugggcuauccaccaucccucaacgagcgccgaucaacagaguuuguaucagaacgcggacgcauacguguucgucggcacuucucgcuacuccaagaaauuuaagccugagauugccauccgaccaaaagugcgugaucaggaggggagaaugaauuauuacuggacccugguggaacccggagacaagauuacauucgaggcuacugguaaccuagucguuccuagguaugccuuugcaauggaacggaacgcuggcagcgggaucauaauuucggauaccccagugcacgacugcaauacaaccugucaaacgccgaaaggagccaucaacacuucucuccccuuccagaauauucauccuaucacaaucggcaagugcccaaaguacguaaaauccaccaagcugcgccuugcgacuggucugagaaacgugcccucaauucagaguaggggguuguuuggagccauagcaggcuucaucgagggcggguggacaggaauggucgacgguugguauggcuaccaccaccagaaugaacaagggagcggauaugcugccgaucucaaauccacccagaacgcuauugacgagaucacgaauaaggugaacucuguuauagagaaaaugaauacccaguuuacagccgugggcaaggaguucaaccaucuggagaagcggauugaaaauuuaaacaaaaaggucgaugacgguuuccuggauaucuggacuuacaaugcagagcuccuugugcuguuggaaaacgagcgcacccuagacuaccacgauagcaauguaaagaaccuguaugagaagguucgaucacagcucaaaaacaaugccaaggaaaucgggaacggcuguuuugaguucuaccauaagugcgacaauacauguauggaaagugugaaaaacggaacuuaugauuacccuaaguauuccgaggaagcuaaacugaauagagaggagauugacggcgucaaacuugaaagcaccaggaucuaccaaauucuggcgauauauucuacaguggcaucaaguuugguccucgugguuagccugggggccaucuccuuuuggaugugcucuaacggaucguuacagugccggauuuguaucuga

SEQ ID NO: 127258 - RNA, 1701 nt, Artificial Sequence; identical to SEQ ID NO: 126872
  derived and/or modified sequence opt3 from hemagglutinin__InfluenzaA__ADK32390

SEQ ID NO: 127259 - RNA, 1701 nt, Artificial Sequence; identical to SEQ ID NO: 126872
  derived and/or modified sequence opt3 from hemagglutinin__InfluenzaA__ADK32400

SEQ ID NO: 127260 - RNA, 1701 nt, Artificial Sequence
  derived and/or modified sequence opt3 from hemagglutinin__InfluenzaA__ADK32420
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguacgaaaccagcucaaaaauaacgcaaaggagaucggcaauggauguuuugaguucuaucacaagugcgauaacacauguauggagagugugaaaaauggcacuuacgacuaucccaaguacuccgaagaggccaaacugaacagagaggaaauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127261 - RNA, 1701 nt, Artificial Sequence; identical to SEQ ID NO: 126237
  derived and/or modified sequence opt3 from hemagglutinin__InfluenzaA__ADK32430

SEQ ID NO: 127262 - RNA, 1701 nt, Artificial Sequence
  derived and/or modified sequence opt3 from hemagglutinin__InfluenzaA__ADK32440
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgguaucacgaauaaggugaacucuguuauagagaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauagcaauguaaagaaccuguacgagaagguucgaucacagcucaaaaacaaugcaaaggagaucggaaacggcuguuuugaguucuaucacaagugcgacaauacauguauggaaagugugaaaaacgggacuuacgauuauccuaaguacuccgaagaggccaaacugaauagagaagagauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 127263 - RNA, 1701 nt, Artificial Sequence
  derived and/or modified sequence opt3 from hemagglutinin__InfluenzaA__ADK32450
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugaugcuccagugcaugacugcaauacuaccugucaaacaccgaaaggcgccauuaacaccucccuacccuuccagaauauccacccuaucacgauugguaagugcccaaaguauguaaaaucaacuaagcuccgccuggcgacagggcuuagaaacgugcccaguauacagagcaggggacuguuuggcgccaucgcaggcuucauugaagggggauggaccgguauggucgacggcugguacggguaucaucaccagaaugaacaaggauccggcuacgcugccgauuugaaaucuacucagaacgcuaucgacgagauaacaaauaaggugaacagcguuauugagaaaaugaauacccaguuuacggccguggguaaggaguucaaccaccucgagaagcggaucgaaaaucugaacaaaaaggucgaugacggguucuuagauaucuggaccuacaaugcagagcugcucgugcuucuggaaaacgagcgcacauuggacuaucaugauucaaauguuaaaaaccuauacgagaagguacgaagucagcugaaaaacaaugccaaggaagugggcaacggauguuuugaguucuaucacaagugcgacaauacuuguauggaauccgucaaaaacggcaccuacgauuauccuaaguacagcgaggaagcuaaacucaauagagaggagauugacggggugaagcuggaaucuacaaggaucuaucaaauucuugcgauauacucaacugcagccaguagccuggucuuggugguuucccucggagcuaucucuuuuuggaugugcucgaacgguagccugcagugccggauuuguaucuga

SEQ ID NO: 127264 - RNA, 1701 nt, Artificial Sequence
  derived and/or modified sequence opt3 from hemagglutinin__InfluenzaA__ADK32460
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacgcauucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 127265 - RNA, 1701 nt, Artificial Sequence; identical to SEQ ID NO: 125849
  derived and/or modified sequence opt3 from hemagglutinin__InfluenzaA__ADK32470

SEQ ID NO: 127266 - RNA, 1701 nt, Artificial Sequence
  derived and/or modified sequence opt3 from hemagglutinin__InfluenzaA__ADK32480
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagcucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 127267 - RNA, 1701 nt, Artificial Sequence; identical to SEQ ID NO: 125849
  derived and/or modified sequence opt3 from hemagglutinin__InfluenzaA__ADK32490

SEQ ID NO: 127268 - RNA, 1701 nt, Artificial Sequence; identical to SEQ ID NO: 125849
  derived and/or modified sequence opt3 from hemagglutinin__InfluenzaA__ADK32502

SEQ ID NO: 127269 - RNA, 1701 nt, Artificial Sequence; identical to SEQ ID NO: 126321
  derived and/or modified sequence opt3 from hemagglutinin__InfluenzaA__ADK32637

SEQ ID NO: 127270 - RNA, 1701 nt, Artificial Sequence; identical to SEQ ID NO: 125849
  derived and/or modified sequence opt3 from hemagglutinin__InfluenzaA__ADK32647

SEQ ID NO: 127271 - RNA, 1701 nt, Artificial Sequence; identical to SEQ ID NO: 126013
  derived and/or modified sequence opt3 from hemagglutinin__InfluenzaA__ADK32657

SEQ ID NO: 127272 - RNA, 1701 nt, Artificial Sequence; identical to SEQ ID NO: 126237
  derived and/or modified sequence opt3 from hemagglutinin__InfluenzaA__ADK32677

SEQ ID NO: 127273 - RNA, 1701 nt, Artificial Sequence
  derived and/or modified sequence opt3 from hemagglutinin__InfluenzaA__ADK32687
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaauuuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucuaacguaaagaaccuguacgagaaaguucgaagccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 127274 - RNA, 1701 nt, Artificial Sequence; identical to SEQ ID NO: 126476
  derived and/or modified sequence opt3 from hemagglutinin__InfluenzaA__ADK32697

SEQ ID NO: 127275 - RNA, 1701 nt, Artificial Sequence; identical to SEQ ID NO: 125849
  derived and/or modified sequence opt3 from hemagglutinin__InfluenzaA__ADK32776

SEQ ID NO: 127276 - RNA, 1701 nt, Artificial Sequence; identical to SEQ ID NO: 126237
  derived and/or modified sequence opt3 from hemagglutinin__InfluenzaA__ADK33621

SEQ ID NO: 127277 - RNA, 1701 nt, Artificial Sequence
  derived and/or modified sequence opt3 from hemagglutinin__InfluenzaA__ADK33631
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagugaagcacaaugggaaacuauguaagcucagaggaguugcuccccugcaucuugguaaaugcaacauagccggcuggauccuggggaauccugagugugaaucuuugucaacagcaaguagcugguccuacauuguggagaccucuucgucagauaacggaacuugcuauccaggcgacuuuaucaauuacgaggagcucagggagcagcugagcagugucuccucuuucgaacgguuugagauuuucccgaagacaagcuccuggcccaaccacgauucaaauaagggugugaccgccgcuuguccucaugcaggggccaaaaguuuuuauaagaaccugaucuggcucguuaaaaagggaaauagcuacccaaaauuaucuaaguccuauauaaacgacaagggcaaagaaguacuggugcuuuggggcauccaccaccccucaacgagcgcugaucaacagaguuuguaccagaaugccgacgcguacgucuucguggggacuucucgcuauuccaagaaauuuaagccugagauugcaauccgaccaaaagugcgugaucaggagggaagaaugaacuacuauuggacccuggucgaacccggugacaagauuacauucgaggccacuggcaaccuaguugugccuagguacgcuuuugccauggaacggaaugcagggagcggaaucauaauuucggauaccccaguacaugacugcaacacaaccugucaaacgccgaaaggcgcuaucaauacuucucuccccuuccagaacauucacccuaucacaaucgguaagugcccaaaguaugugaaauccaccaagcugcgccuugccacugggcugagaaauguccccucaauucagaguaggggauuguuuggcgcgauagccggcuucaucgaagggggauggacagguaugguggauggcugguacggguaucaucaccagaacgaacaaggaagcggcuacgcagcugaccucaaauccacccagaaugccauugacaagaucacgaacaaaguuaauucugugauagagaagaugaacacccaguuuacagcugucgguaaggaguucaaucaccuggaaaaacggauugagaacuuaaauaagaaaguggaugacggguuccuggauaucuggacuuacaacgccgaacuccuuguacuguuggagaaugaacgcacccuagacuaucaugauagcaacguuaagaaccuguacgagaaagugcgaucacagcucaagaauaacgcaaaggagaucggcaauggauguuuugaguucuaucacaaaugcgacaacacauguauggaaagugucaagaauggcacuuacgauuauccuaaauacuccgaagaggccaagcugaacagagaagagauugacggggugaaacuugagagcaccaggaucuaucaaauucuggcuauauacucuacagucgcgucaaguuuggugcucguugugagccugggagcaaucuccuuuuggaugugcucuaaugguucguuacagugccggauuuguaucuga

SEQ ID NO: 127278 - RNA, 1701 nt, Artificial Sequence; identical to SEQ ID NO: 126237
  derived and/or modified sequence opt3 from hemagglutinin__InfluenzaA__ADK33641

SEQ ID NO: 127279 - RNA, 1701 nt, Artificial Sequence; identical to SEQ ID NO: 125849
  derived and/or modified sequence opt3 from hemagglutinin__InfluenzaA__ADK33651

SEQ ID NO: 127280 - RNA, 1701 nt, Artificial Sequence; identical to SEQ ID NO: 125849
  derived and/or modified sequence opt3 from hemagglutinin__InfluenzaA__ADK33661

SEQ ID NO: 127281 - RNA, 1701 nt, Artificial Sequence; identical to SEQ ID NO: 125849
  derived and/or modified sequence opt3 from hemagglutinin__InfluenzaA__ADK33671

SEQ ID NO: 127282 - RNA, 1701 nt, Artificial Sequence
  derived and/or modified sequence opt3 from hemagglutinin__InfluenzaA__ADK33681
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaagcuguacgagaaaguacgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127283 - RNA, 1701 nt, Artificial Sequence; identical to SEQ ID NO: 126298
  derived and/or modified sequence opt3 from hemagglutinin__InfluenzaA__ADK33691

SEQ ID NO: 127284 - RNA, 1701 nt, Artificial Sequence
  derived and/or modified sequence opt3 from hemagglutinin__InfluenzaA__ADK33701
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggguguaucaaauccuggcuauuuacucuacagucgcgucaaguuuggugcucguugugagccugggagcaauauccuuuuggaugugcucuaacgguucguuacagugccggaucuguauuuga

SEQ ID NO: 127285 - RNA, 1701 nt, Artificial Sequence
  derived and/or modified sequence opt3 from hemagglutinin__InfluenzaA__ADK33711
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaauccugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacauacccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 127286 - RNA, 1701 nt, Artificial Sequence
  derived and/or modified sequence opt3 from hemagglutinin__InfluenzaA__ADK33721
augaaggccauccuggugguccuccuuuacaccuucguuacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagcacgcuauugacgagaucacgaacaagguuaauucugugauagagaaaaugaacacccaguuuacagccgucgguaaggaguucaaucaucuggaaaagcggauugaaaacuuaaauaaaaagguggaugacggguuccuggauaucuggacuuacaacgcugagcuccuuguacuguuggaaaaugagcgcacccuagacuaucacgauagcaacguuaaaaaucuguacgagaaggugcgaucacagcucaaaaacaacgccaaggaaaucggcaauggauguuuugaguucuaucauaagugcgacaacacauguauggaaagugucaaaaauggcacuuacgauuauccuaaguacuccgaggaagcaaaacugaacagagaggagauugacggggugaaacuugaaagcaccaggaucuaucaaauucuggccauauacucuacagucgcuucaaguuuggugcucguugugagccugggagcgaucuccuuuuggaugugcucuaaugguucguuacagugccggauuuguaucuga

SEQ ID NO: 127287 - RNA, 1701 nt, Artificial Sequence
  derived and/or modified sequence opt3 from hemagglutinin__InfluenzaA__ADK33731
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucaggaaacggcacaugcuauccaggugacuuuauugauuacgaagaacucagggagcagcugagcaguguguccucuuucgaacgguuugagaucuucccgaagaccagcuccuggcccaaucacgacucaaacaagggggucacggccgcuuguccucaugcaggagccaaaaguuuuuauaagaaucugauuuggcucgugaaaaagggcaacagcuacccaaaauuaucuaaguccuauaucaaugauaagggcaaagaaguacugguucuuugggggauacaccaccccucaacuagcgcugaccaacagaguuuguaccagaacgccgaugcguacgcauucgugggaaccucucgcuauuccaagaaauuuaagccugagaucgccauucgaccaaaaguccgugaccaggaggguagaaugaauuacuauuggacacugguggaacccggcgauaagaucacuuucgaggcuaccgggaaccuacucgugccuagguacgccuuugcaauggaacggaacgcuggaagcggcauuaucauaucggacacaccaguccaugauugcaauaccacgugucaaacuccgaaaggugccauuaacacaucucugcccuuccagaauauccacccuauuaccaucgggaagugcccaaaguauguuaaauccacuaaacuucgccuggcgacaggauugagaaacgugcccucaauccagaguaggggccucuuuggcgccauugcaggguucauagagggagguuggaccggcaugguagacgggugguacggauaucaucaccagaaugaacaaggcagcgguuacgcugccgaccugaaauccacgcagaacgcuaucgaugagauuaccaauaaggugaacucugucaucgagaaaaugaauacacaguuuacugccguggggaaggaguucaaccacuuagagaagcggauagaaaaucugaacaaaaagguugacgauggcuuccucgacauuuggaccuacaaugcagagcuucugguguugcuagaaaacgagcgcacacuggauuaucaugacagcaaugucaaaaaccucuacgagaaggugcgaucacagcugaaaaacaaugccaaggaaaucggaaacggcuguuuugaguucuaucacaagugcgauaauacuuguauggaaaguguaaagaacgggaccuacgacuauccuaaguacuccgaggaagcuaaacuuaauagagaggagaucgauggaguuaagcuggaaagcacaaggauuuaucaaaucuuggcgauuuacucuaccguggcaucaagucucguccugguggucagcuuaggugccauauccuuuuggaugugcucuaacggcucgcugcagugccggaucuguauuuga

SEQ ID NO: 127288 - RNA, 1701 nt, Artificial Sequence; identical to SEQ ID NO: 126852
  derived and/or modified sequence opt3 from hemagglutinin__InfluenzaA__ADK33741

SEQ ID NO: 127289 - RNA, 1701 nt, Artificial Sequence; identical to SEQ ID NO: 124685
  derived and/or modified sequence opt3 from hemagglutinin__InfluenzaA__ADK33751

SEQ ID NO: 127290 - RNA, 1701 nt, Artificial Sequence
  derived and/or modified sequence opt3 from hemagglutinin__InfluenzaA__ADK33761
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugucacuugccacugggcugcgcaacgugcccaguauucagagcagaggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagaggauugaaaauuuaaacaaaaaggucgaugacggguuccuggauaucuggacuuacaaugccgagcuccuugugcuguuggaaaacgagcggacccuagacuaucaugauucaaauguaaagaaccuguacgagaagguucgcagucagcucaaaaacaaugcaaaggaaaucggcaacggauguuuugaguucuaucacaagugcgacaauacauguauggaauccgugaaaaacggcacuuacgauuauccuaaguacagcgaggaagccaaacugaaucgagaggagauugacggggucaaacuugaaucuaccagaaucuaucaaauucuggcuauauacucaacaguggcgaguagcuugguccucgugguuucccugggagcaaucucuuuuuggaugugcucgaacgguagcuuacagugcaggauuuguaucuga

SEQ ID NO: 127291 - RNA, 1701 nt, Artificial Sequence; identical to SEQ ID NO: 125849
  derived and/or modified sequence opt3 from hemagglutinin__InfluenzaA__ADK33771

SEQ ID NO: 127292 - RNA, 1701 nt, Artificial Sequence; identical to SEQ ID NO: 125849
  derived and/or modified sequence opt3 from hemagglutinin__InfluenzaA__ADK33781

SEQ ID NO: 127293 - RNA, 1701 nt, Artificial Sequence; identical to SEQ ID NO: 125786
  derived and/or modified sequence opt3 from hemagglutinin__InfluenzaA__ADK33791

SEQ ID NO: 127294 - RNA, 1701 nt, Artificial Sequence; identical to SEQ ID NO: 127284
  derived and/or modified sequence opt3 from hemagglutinin__InfluenzaA__ADK33801

SEQ ID NO: 127295 - RNA, 1701 nt, Artificial Sequence
  derived and/or modified sequence opt3 from hemagglutinin__InfluenzaA__ADK33811
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagcacgccauugacgagaucacgaacaagguaaauucuguuauagagaaaaugaacacccaguuuacagcuguggguaaggaguucaaucaucuggaaaagcggauugaaaacuuaaauaaaaaggucgaugacggguuccuggauaucuggacuuacaacgccgagcuccuugugcuguuggaaaaugagcgcacccuagacuaucacgauagcaacgugaaaaaucuguacgagaagguucgaucacagcucaaaaacaacgcaaaggaaaucggcaauggauguuuugaguucuaucauaagugcgacaacacauguauggaaagugugaaaaauggcacuuacgauuauccuaaguacuccgaggaagccaaacugaacagagaggagauugacgggaucaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127296 - RNA, 1701 nt, Artificial Sequence
  derived and/or modified sequence opt3 from hemagglutinin__InfluenzaA__ADK33821
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuuaccauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaaaccagcucaaaaauaacgccaaggaaaucggcaauggauguuuugaguucuaucacaagugcgacaacacuuguauggaaucagugaaaaauggcaccuacgauuauccuaaguacagugaggaagcaaaacugaacagagaggagauugacggggucaaacuugaauccacaaggaucuaucaaauucuggccauauacagcaccguggcuucuucauugguccucgcggugagucugggagcaaucagcuuuuggaugugcuccaaugguucuuuacagugccggauuuguaucuga

SEQ ID NO: 127297 - RNA, 1701 nt, Artificial Sequence
  derived and/or modified sequence opt3 from hemagglutinin__InfluenzaA__ADK33831
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaauacaagcuccuggcccaaccacgauucaaauaagggugugaccgccgcuuguccucaugcaggggccaagaguuuuuauaaaaaccugauauggcucgucaagaaaggaaauagcuacccaaaguuaucuaaauccuauaucaacgacaagggcaaggaagugcugguacuuuggggcauucaccaccccucaacgagcgcugaucaacagaguuuguaccagaaugccgacgcguacguuuucguggggacuucucgcuauuccaaaaaguuuaaaccugagaucgcaauucgaccaaagguccgugaucaggagggaagaaugaacuacuauuggacccugguggaacccggugacaaaaucacauucgaggccacuggcaaccuaguggucccuagguacgcuuuugccauggaacggaaugcagggagcggaauaauuaucucggauaccccaguucaugacugcaacacaaccugucaaacgccgaagggcgcuauuaauacuucucuccccuuccagaacauccacccuaucacaauugguaaaugcccaaaguaugugaaguccaccaaacugcgccuugccacugggcugagaaauguacccucaauacagaguaggggauuguuuggcgcgaucgccggcuucauugaagggggauggacagguaugguggacggcugguacggguaucaucaccagaacgaacaaggaagcggcuacgcagcugaucucaaguccacccagaaugccaucgacgagauaacgaacaaagucaauucugugauugagaagaugaacacccaguuuacagcuguugguaaagaguucaaucaccuggaaaagcggaucgaaaacuuaaauaagaaaguggaugacggguuccuggauaucuggacuuacaacgccgagcuccuuguccuguuggaaaaugagcgcacccuagacuaucaugauagcaacgugaagaaccuguacgagaaaguacgaucacagcucaagaauaacgcaaaagaaauuggcaauggauguuuugaguucuaucacaagugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127298 - RNA, 1701 nt, Artificial Sequence; identical to SEQ ID NO: 126105
  derived and/or modified sequence opt3 from hemagglutinin__InfluenzaA__ADK33841

SEQ ID NO: 127299 - RNA, 1701 nt, Artificial Sequence; identical to SEQ ID NO: 126852
  derived and/or modified sequence opt3 from hemagglutinin__InfluenzaA__ADK33851

SEQ ID NO: 127300 - RNA, 1701 nt, Artificial Sequence; identical to SEQ ID NO: 124685
  derived and/or modified sequence opt3 from hemagglutinin__InfluenzaA__ADK33861

SEQ ID NO: 127301 - RNA, 1701 nt, Artificial Sequence
  derived and/or modified sequence opt3 from hemagglutinin__InfluenzaA__ADK33871
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucaucccuagguacgcuuuugccauggagcggaacgcagggagcggaauaauuaucucggacaccccaguucaugauugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugagcaaggaagcggcuacgcagcugaccucaaauccacccagaacgccaucgaugagauaacgaauaaggucaacucugugauugaaaagaugaauacccaguuuacagcuguugguaaggaguucaaccaccuggaaaagcggaucgagaauuuaaacaaaaagguggacgauggguuccuggacaucuggacuuacaaugccgaacuccuuguccuguuggagaacgagcgcacccuagauuaucaugacagcaaugugaaaaaccuguacgaaaagguacgaucacagcucaaaaacaaugcaaaggagauuggcaacggauguuuugaguucuaucacaagugcgauaauacauguauggagaguguuaaaaacggcacuuacgacuauccuaaguacuccgaagaggccaaacugaauagagaggaaaucgauggggugaaacuugagagcaccaggauuuaucaaauacuggcuaucuacucuacagucgcgucaaguuuggugcuccuggucagcuuaggagcaauuuccuuuuggaugugcucuaacgguucgcugcagugccggaucuguaucuga

SEQ ID NO: 127302 - RNA, 1701 nt, Artificial Sequence
  derived and/or modified sequence opt3 from hemagglutinin__InfluenzaA__ADK33881
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaaaauuuaucaaauacuugcuaucuacucuacaguggcgucaagucuggucuuggugguuagccucggagcaauuuccuuuuggaugugcucuaacgguucgcugcagugcaggaucuguaucuga

SEQ ID NO: 127303 - RNA, 1701 nt, Artificial Sequence
  derived and/or modified sequence opt3 from hemagglutinin__InfluenzaA__ADK33891
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaaaccagcucaaaaauaacgcaaaggaaauuggcaauggauguuuugaguucuaucacaagugcgacaacacauguauggaaucaguuaaaaauggcacuuacgauuauccuaaguacagugaggaagccaaacugaacagagaggagaucgacggggugaaacuugaauccaccaggauuuaucaaauacuggcuaucuacagcacagucgcgucuucauuggugcucgucgugagucugggagcaauuagcuuuuggaugugcuccaaugguucuuuacagugccggaucuguaucuga

SEQ ID NO: 127304 - RNA, 1701 nt, Artificial Sequence; identical to SEQ ID NO: 126852
  derived and/or modified sequence opt3 from hemagglutinin__InfluenzaA__ADK33901

SEQ ID NO: 127305 - RNA, 1701 nt, Artificial Sequence
  derived and/or modified sequence opt3 from hemagglutinin__InfluenzaA__ADK33911
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucauaaagaagggcaacagcuacccaaaauuaucuaaguccuauaucaaugauaagggcaaagaagugcugguacuuugggggauucaccaccccucaacgagcgcugaccaacagaguuuguaccagaacgccgaugcguacguuuucgugggaacuucucgcuauuccaagaaauuuaagccugagaucgcaauucgaccaaaaguccgugaccaggaggguagaaugaauuacuauuggacccugguggaacccggcgauaagaucacauucgaggccacugggaaccuaguggucccuagguacgcuuuugccauggaacggaacgcaggaagcggcauaauuaucucggacaccccaguucaugauugcaauacaaccugucaaacgccgaaaggugcuauuaacacuucucuccccuuccagaauauccacccuaucacaauugggaagugcccaaaguaugugaaauccaccaagcugcgccuugccacuggacugagaaacauacccucaauccagaguaggggcuuguuuggcgcgauugccggguucaucgagggagguuggacaggcaugguagacgggugguacggauaucaucaccagaaugaacaaggcagcgguuacgcagcugaccucaaauccacccagaacgccauagaugagauuacgaauaaggugaacucugucaucgagaaaaugaauacccaguuuacagcuguggggaaggaguucaaccaccuggagaagcggaucgaaaauuuaaacaaaaagguugacgauggcuuccuggacauuuggacuuacaaugccgagcuccuugugcuguuggaaaacgagcgcacccuagauuaucaugacagcaaugucaaaaaccuguacgagaaggugcgaucacagcucaaaaacaaugcaaaggaaaucggaaacggcuguuuugaguucuaucacaagugcgauaauacauguauggaaaguguuaaaaacgggacuuacgacuauccuaaguacuccgaggaagccaaacugaauagagaggagauugauggaguaaaacuugaaagcaccaggauauaucaaauccuggcuauuuacucuacaguggcgucaaguuugguccucguggucagccugggugcaaucuccuuuuggaugugcucuaacggcucguuacagugccggaucuguauuuga

SEQ ID NO: 127306 - RNA, 1701 nt, Artificial Sequence
  derived and/or modified sequence opt3 from hemagglutinin__InfluenzaA__ADK33931
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccuccuggugagcuuaggagcaaucuccuuuuggaugugcucuaacgguucgcugcagugccggauuuguaucuga

SEQ ID NO: 127307 - RNA, 1701 nt, Artificial Sequence
  derived and/or modified sequence opt3 from hemagglutinin__InfluenzaA__ADK33941
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucgugauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacauccccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127308 - RNA, 1701 nt, Artificial Sequence; identical to SEQ ID NO: 127305
  derived and/or modified sequence opt3 from hemagglutinin__InfluenzaA__ADK33951

SEQ ID NO: 127309 - RNA, 1701 nt, Artificial Sequence; identical to SEQ ID NO: 125849
  derived and/or modified sequence opt3 from hemagglutinin__InfluenzaA__ADK33961

SEQ ID NO: 127310 - RNA, 1701 nt, Artificial Sequence; identical to SEQ ID NO: 125629
  derived and/or modified sequence opt3 from hemagglutinin__InfluenzaA__ADK45312

SEQ ID NO: 127311 - RNA, 1701 nt, Artificial Sequence
  derived and/or modified sequence opt3 from hemagglutinin__InfluenzaA__ADK45410
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaaguuuaaguacccagcacugaaugugaccaugcccaacaacgagcaguucgacaaacuuuauauuuggggaguccaucacccuggcacagauaaugaccagaucuuuuuguacgcccaagcuagcggccguauuacugugucuaccaagagaucccagcagacaguaaucccaaacauagggucaaggccccggguucgcaauauuccuagcagaaucaguauuuauuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauacggugcauguccuagauaugugaaacaaaauacccugaagcuggccacugggaugaggaacgugccagagaaacagacacggggaaucuucggcgcuauugccggcuuuaucgaaaaugggugggagggaauggucgaugguugguacggcuuccgucaccagaacagugaggggcgcggacaagcagcugaccuuaagagcacccaggccgcgauugaucagauaaauggcaaauugaacagacucaucgguaagacgaacgaaaaauuccaucagauugagaaggaauuuuccgagguugaagggaggauccaagaccuggagaaguauguggaggauaccaaaaucgacuuauggucuuacaaugccgaacugcucguagcacuugagaaccagcacacaauugaucugacugacagcgaaaugaauaaguuguucgagaaaaccaagaaacagcuacgggaaaacgcugaggauaugggcaauggaugcuuuaagauauaucauaagugugacaacacaugcaucggcucaauucgaaaugggacuuacgaucacgacguguaucgcgacgaggcccugaacaauagauuccagaucaaaggagucgaacucaagagugguuacaaagauuggauucuguggaucuccuuugcuauaagcugcuuccuucuguguguggccuugcucggcuuuaucaugugggcaugccaaaaggggaacauuagguguaauaucugcauuuga

SEQ ID NO: 127312 - RNA, 1701 nt, Artificial Sequence
  derived and/or modified sequence opt3 from hemagglutinin__InfluenzaA__ADK45421
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuagcggccguauuacugugucuaccaagagaucccagcagacaguaaucccaaauauagggucaaggccccggauucgcaacaucccuagcagaauuaguaucuacuggaccaucguuaaaccaggagauauucugcuaauaaauucuacggguaaccucaucgccccgaggggcuacuucaagauucgguccggaaagagcucgaucaugcgcucugacgcgcccauagggaaauguaauuccgagugcauuacuccuaacggcucaaucccaaaugacaagcccuuucagaacgugaaucgaaucacauauggugcauguccuagauacgucaaacaaaguacccugaaacuugccacugggaugaggaacgugccagaaaagcagacacggggaauuuucggcgcuaucgccggcuuuauugagaaugggugggaaggaaugguggaugguugguauggcuuccgucaccagaacagcgaggggcgcggacaagcagcugaccugaaguccacccaggccgcgauagaucagaucaauggcaaauugaacagacucauugguaagacgaaugagaaguuccaccagaucgaaaaagaguuuucugaagucgaggggaggauccaagaccuggaaaaguacguugaggauaccaaaauugacuuauggagcuauaacgccgagcugcucguggcacuugaaaaccagcauacaauagaucugacugacucagagaugaauaaguuguucgaaaagaccaagaagcagcuacgggagaacgcugaagauaugggcaauggaugcuuuaaaaucuaccacaagugugacaacgccugcauuggcaguauccgaaaugggacauaugaucaugacguauaccgcgacgaggcucugaacaauagauuccagauuaaaggaguggagcucaaguccgguuacaaagauuggauccuguggaucagcuuugccauaucuugcuuccuucugugugucgcauugcucggcuuuauuaugugggccugccaaaaggggaacaucagguguaauauuugcaucuga

SEQ ID NO: 127313 - RNA, 1701 nt, Artificial Sequence
  derived and/or modified sequence opt3 from hemagglutinin__InfluenzaA__ADK45432
augaagaccaucauugcccugagcuacacacucugccuuguguucgcucagaaacugcccagaaacgacaauuccacugcaacguuguguuuaggccaccaugccgucccuaacgggaccauaguuaagacaaucacuaaugaucaaauugaggugaccaacgcgacagaacugguacagucuucaaguaccggagagaucugcgacaauccacaccagauucuagauggugaaaacuguacucucaucgacgcucugcuuggcgauccgcagugcgacggguuucaaaauaaaaagugggaucuguucguggagaggagcaaagccuauuccaacuguuaccccuaugacgucccugauuacgcaucuuugcggucgcucguggccucaagcggaacacuggaauuuaauaacgagaguuucaauuggaccggcguuacgcagaacgguacuuccucugcuugcauacgccgaagcaauaacuccuuuuucucacgucugaauuggcucacccauuuaaaguuuaaguauccagcacugaacgugacaaugcccaacaaugagcaguucgacaaacuuuacaucuggggaguccaccauccugggacugauaacgaccagauuuuucuuuaugcccaagcuaguggcagaaucaccgugagcacaaagaggucucagcagaccguaauuccaaauaucggcucccggccccgcguuagaaacauaccuucaaggauuagcaucuacuggacgauugugaaaccaggggauauccugcuaaucaauaguacuggaaaccucauugccccgcgggguuacuucaagauacgcucuggcaaauccagcaucaugcgaucggacgcgcccauugggaaguguaauucugaaugcaucacaccuaacggauccauaccaaaugacaagcccuuucagaacgucaauagaauuaccuauggcgcauguccuagguacgugaaacaaaacacucugaaguuggccacagguaugcggaaugugccagagaaacagacccgugggaucuucggagcuaucgccggcuuuauugaaaacggcugggaggggauggucgauggaugguaugguuuccgccaccaaaauucagagggcagagggcaggcagcugaccugaagaguacgcaggccgcgaucgaucagauuaacggaaaauugaacaggcucauaggcaagaccaaugaaaaauuccaccagaucgagaaggaauuuagcgagguugaaggucggauucaagaccuggagaaguacguggaggauacaaaaaucgacuuaugguccuauaacgccgaacugcucguagcacuugagaaucagcauacuaucgaucugaccgacucugaaaugaacaaguuguucgagaaaacaaagaaacagcuacgagaaaaugcugaggauauggggaacggcugcuuuaagauuuaccacaagugugacaaugccugcauaggaagcauccgcaacggcacuuaugaucaugacguguacagagacgaggcucugaauaacagguuccagauuaaaggggucgaacucaagucaggauacaaagauuggauccuguggauuaguuuugccaucuccugcuuccuucuguguguggcauugcucgguuuuauaaugugggccugccaaaagggcaauauccgguguaacauuugcaucuga

SEQ ID NO: 127314 - RNA, 1701 nt, Artificial Sequence; identical to SEQ ID NO: 124450
  derived and/or modified sequence opt3 from hemagglutinin__InfluenzaA__ADK45443

SEQ ID NO: 127315 - RNA, 1701 nt, Artificial Sequence; identical to SEQ ID NO: 126849
  derived and/or modified sequence opt3 from hemagglutinin__InfluenzaA__ADK48798

SEQ ID NO: 127316 - RNA, 1701 nt, Artificial Sequence; identical to SEQ ID NO: 125849
  derived and/or modified sequence opt3 from hemagglutinin__InfluenzaA__ADK62683

SEQ ID NO: 127317 - RNA, 1701 nt, Artificial Sequence
  derived and/or modified sequence opt3 from hemagglutinin__InfluenzaA__ADK62693
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugaguguggaucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagaacgccgacgcguacguguucgucggaacuucucgcuauuccaagaaauuuaagccugaaauugcaauccgaccaaaagugcgugagcaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauguacacccuauuacaaucgggaagugcccaaaguaugugaaauccaccaagcugcgccuugccacuggacugagaaacguccccucaauccagaguaggggcuuguuuggcgcgauugccggguucauagagggagguuggacaggcaugguggacgggugguacggauaucaucaccagaaugaacaaggcagcgguuacgcagcugaccucaaauccacccagaacgccaucgaugagauuacgaauaagguuaacucugugaucgagaaaaugaauacccaguuuacagcugucgggaaggaguucaaccaccuggaaaagcggauagaaaauuuaaacaaaaagguggacgauggcuuccuggacauuuggacuuacaaugccgagcuccuuguacuguuggaaaacgagcgcacccuagauuaucaugacagcaauguuaaaaaccuguacgagaaggugcgaucacagcucaaaaacaaugcaaaggaaaucggaaacggcuguuuugaguucuaucacaagugcgauaauacauguauggaaagugucaaaaacgggacuuacgacuauccuaaguacuccgaggaagccaaacugaauagagaggagaucgauggagugaaacuugaaagcaccaggauuuaucaaauccuggcuauuuacucuacagucgcgucaaguuuggugcucguugugagccugggugcaauauccuuuuggaugugcucuaacggcucguuacagugccggaucuguauuuga

SEQ ID NO: 127318 - RNA, 1701 nt, Artificial Sequence; identical to SEQ ID NO: 125786
  derived and/or modified sequence opt3 from hemagglutinin__InfluenzaA__ADK62703

SEQ ID NO: 127319 - RNA, 1701 nt, Artificial Sequence
  derived and/or modified sequence opt3 from hemagglutinin__InfluenzaA__ADK64992
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacgggaucaaacuugaaagcaccaggauuuaucaaauacuggcuaucuacucuacagucgcgucaaguuuggugcucgucgugagccugggagcaauuuccuuuuggaugugcucuaacgguucguuacaguaccggaucugcaucuga

SEQ ID NO: 127320 - RNA, 1701 nt, Artificial Sequence
  derived and/or modified sequence opt3 from hemagglutinin__InfluenzaA__ADK65001
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccaggugauuuuaucgacuacgaagaacucagagagcagcugagcaguguguccucuuucgaaagguuugagauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagaaguacugguucuuugggggauccaccaccccucaacgagcgcugaucaacagaguuuguaccagaacgccgacgcguacguguucgucggaacuucucgguauuccaagaaauuuaagccugagauugcaauccgcccaaaagugcgagaucaggagggucguaugaauuacuauuggacccugguggaacccggcgacaagauuacauucgaggccacugggaaccuagucguuccuagauacgcuuuugccauggaaaggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaucucaaauccacccagaacgccauugacgagaucacgaauaaggugaacucuguuauagagaaaaugaauacccaguuuacagcuguggggaaggaguucaaccaccuggagaagaggauugaaaauuuaaacaaaaaggucgaugacggcuuccuggauaucuggacuuacaaugccgagcuccuugugcuguuggaaaacgagcggacccuagacuaucaugauagcaauguuaaaaaccuguacgagaagguacgcucacagcucaaaaacaaugcaaaggaaaucggaaacggcuguuuugaguucuaucacaagugcgacaauacaugucuggaaagugugaaaaacgggacuuacgauuauccuaaguacuccgaggaagccaaacuuaaucgagaggagauugacggagucaagcuggaaagcaccagaaucuaucaaauuuuggcuauauacucuacaguggcgucaagucucguccuggugguuagcuuaggugcaaucuccuuuuggaugugcucuaacggcucgcugcagugcaggauuuguaucuga

SEQ ID NO: 127321 - RNA, 1701 nt, Artificial Sequence
  derived and/or modified sequence opt3 from hemagglutinin__InfluenzaA__ADK65009
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucggcgccacugggaaccuagucguuccaagguacgcuuuugccauggagcggaacgcaggauccggcaucauaauuagcgauaccccggugcaugacugcaauacaaccugucaaacgcccaaaggugcuaucaacacuucgcucccuuuccagaauauucacccaaucacaaucgggaagugccccaaguauguaaaaucuaccaagcugcgccuugccacuggacugagaaacgugccuuccauucagucaaggggcuuguuuggcgcgauagccggguucaucgaaggagguuggacaggcauggucgacgggugguacggauaucaucaccagaaugagcaaggcagugguuacgcagcugaucucaaaagcacccagaacgccauugacgaaaucacgaauaaggugaacuccguuauagagaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauucuaauguaaagaaccuguacgagaagguucgaagccagcucaaaaacaaugcaaaggagaucggaaacggcuguuuugaguucuaucacaagugcgacaauacauguauggagucagugaaaaacgggacuuacgauuauccaaaguacagugaagaggccaaacugaauagagaagagauugacggagucaaacuugaguccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 127322 - RNA, 1701 nt, Artificial Sequence
  derived and/or modified sequence opt3 from hemagglutinin__InfluenzaA__ADK87287
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaguuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccgggaaaagcucgauuaugcgcucugacgcacugaucggaaaauguaauuccgagugcauaacucccaacggcucaauuccuaaugacaagccauuucagaacgugaaucgaaucacauauggugccugucccagauacgucaaacaaaacacccuuaagcuggcuacugggaugaggaaugugccugaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaacucaauagacugaucgguaagacgaacgagaaguuccaccagauugaaaaagaguuuuccgaagucgaggggaggauccaagacuuagaaaaguacguugaggauaccaaaaucgaccuguggucuuauaacgcagagcuccuuguggcucuggaaaaucagcauacaauugauuugacugacagcgagaugaacaagcuauucgaaaagaccaagaagcagcugcgggagaaugccgaagauaugggcaacggaugcuuuaaaauauaccacaagugugacaaugcuugcaucggcucaauucgaaacgggacauaugaucaugacguauaccgcgacgaggcccucaauaacagauuccagaucaaaggaguggagcugaagagugguuacaaagauuggauucuuuggaucuccuuugcaauaagcugcuuccuguugugugucgcccuccugggcuuuaucaugugggcuugccaaaaggggaauauuagguguaacaucugcauuuga

SEQ ID NO: 127323 - RNA, 1701 nt, Artificial Sequence
  derived and/or modified sequence opt3 from hemagglutinin__InfluenzaA__ADK87288
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuacuggccguauuaccgugagcacaaagagaucucagcagaccgccaucccaaauauaggguccaggccccggguacgcaacauuccuucaagaaucagcauuuacuggacgaucguuaaaccaggagauauccugcuaauuaauaguacugguaaccucauagcgccgaggggcuacuucaagauccggucugggaaguccagcauuaugcgcucggacgcacccaucggaaaauguaauucugagugcauaacaccuaacggcuccauuccaaaugacaagcccuuucagaacgugaaucgaaucaccuauggugccuguccuagauacgucaaacaaaacacucugaaacuugcuacagggaugaggaaugugccagaaaagcagacccggggaaucuucggcgccauugcaggcuuuaucgagaacgggugggaaggaaugguggaugguugguauggcuuccgucaccaaaauucagaggggcgcggacaggcugccgaccugaagaguacgcaggcggccauugaucagauaaacggcaaauugaauagacucaucgguaagaccaacgagaaguuccaccagauugaaaaagaguuuagcgaagucgaggggaggauccaagaccuggaaaaguacguugaggauacaaaaaucgacuuaugguccuauaacgcagagcugcucguggcucuugaaaaucagcauacuauugaucugaccgacucugagaugaacaaguuguucgaaaagacaaagaagcagcuacgggagaaugccgaagauaugggcaacggaugcuuuaaaauauaccacaagugugacaaugcuugcaucggcagcauucgaaacgggacuuaugaucaugacguauaccgcgacgaggcccugaauaacagauuccagaucaaaggaguggagcucaagucagguuacaaagauuggauucuguggaucaguuuugcaauauccugcuuccuucugugugucgccuugcucggcuuuaucaugugggcuugccaaaaggggaauauuagguguaacaucugcauuuga

SEQ ID NO: 127324 - RNA, 1701 nt, Artificial Sequence
  derived and/or modified sequence opt3 from hemagglutinin__InfluenzaA__ADK87289
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggguuuuaacaaugaguccuucaacuggacagggguuacccagaauggaacgucuagcgcuugcauccggcgcuccaagaacucauuuuucagucgacugaauuggcucacucauuuaaacuuuaaauauccagcacugaaugugaccaugcccaacaacgaacaguucgacaagcuguacauuuggggcguccaccauccuggcacagauaaagaccagaucuuuuuguaugcccaagcuagcgggcguauuacugugucuaccaagagaucccagcagacagccaucccaaauauaggaucaaggccccggguacgcaacauuccuagcagaaucaguauuuacuggaccaucguuaaaccaggugauauccugcuaauuaauucuacgggcaaccucauagcgccgaggggguacuucaagauccgguccggaaagagcucgauuaugcgcucugacgcacccaucggcaaauguaauuccgagugcauaacuccuaacgguucaauuccaaaugacaagcccuuucagaacgugaaucgaaucacauauggggccuguccuagauacgucaaacaaaacacccugaaacuugcuacuggaaugaggaaugugccagagaaacagacacggggcaucuucggcgccauugcaggguuuaucgaaaacggaugggaggguaugguggauggcugguauggguuccgucaccagaauagugaaggacgcggccaagcugccgaccuuaagagcacccaggcggccauugaucagauaaacgguaaauugaauagacucaucgggaagacgaacgagaaguuccaccagauugagaaagaauuuuccgaggucgaaggcaggauccaagaccugggaaaguacguugaggauaccaaaaucgacuuauggucuuauaacgcagaacugcucguggcucuugagaaucagcauacaauugaucugacugacagcgagaugaacaaguuguucgaaaagaccaagaagcagcuacgggagaaugccgaagauaugggcaacgggugcuuuaaaauauaccacaagugugacaaugcuugcaucggaucaauucgaaacgguacauaugaucaugacguauaccgcgacgaggcccugaauaacagauuccagaucaaaggcguggaacucaagaguggguacaaagauuggauucuguggaucuccuuugcaauaagcugcuuccuucugugugucgccuugcucggauuuaucaugugggcuugccaaaagggcaauauuagguguaacaucugcauuuga

SEQ ID NO: 127325 - RNA, 1701 nt, Artificial Sequence
  derived and/or modified sequence opt3 from hemagglutinin__InfluenzaA__ADK87291
augaagaccaucauugcccugagcuacauacagugccucguguucgcucaaaaacuucccggcaacgacaauuccacagcaacucuguguuuggggcaccaugccgucccuaacggaacgaucguuaagaccauuacaaaugaucagaucgaggugacuaacgcgaccgaauuaguacagucuucaaguacaggugagauuugcgacagcccacaccagauccuggauggcaaaaauuguacccuaauagacgcucuccugggggauccgcaaugcgacggauuucagaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauccggcgcuccaagaacucauuuuucagucgacugaauuggcugacucaucucaacuuuaaauauccagcauuaaaugugaccaugcccaacaacgagcaguucgacaagcuguacauuuggggaguccaccauccuggcacagauaaagaccaaaucagccuuuaugcccaggcuucuggccguauuacuguguccaccaagagaucacagcagacagccaucccaaauauagggagcaggccccggguacgcaacauuccuaguagaaucucuauuuacuggaccaucguuaaaccaggagauaucuugcugauuaauuccacggguaaccuaauagcgccgaggggcuacuuuaagauccggagcgggaagucgucuauuaugcgcuccgacgcacccaucggaaaauguaauucagagugcauaacuccuaacggcaguauuccaaaugacaagcccuuccaaaacgugaaucgaaucacauauggugccuguccuagauacgucaaacagaacacccucaagcuggcuacugggaugaggaaugugccagaaaaacagacacggggaaucuuuggcgccauugcaggcuucaucgagaacgggugggaaggaaugguggaugguugguauggcuuucgucaccaaaauagcgaggggcgcggacaggcugccgaccuuaaguccacccaggcggccauugaucagauaaacggcaaacugaauagauugaucgguaagacgaacgagaaguuccaccaaauugaaaaagaguucucugaagucgaggggaggauccaggaccucggcaaguacguugaagauaccaaaaucgaccuguggagcuauaacgcagaguuacugguggcucucgagaaucagcauacaauugaucuuacugacucagaaaugaacaagcuguuugagaaaaccaagaagcaguugcgggaaaaugccgaggauaugggaaacggcugcuucaaaauauaccacaagugugacaaugcuugcaucgggaguauucgaaacggaacauaugaucaugacguauaccgcgacgaagcccuaaauaacagauuucaaaucaaagguguggagcugaaguccggcuacaaagauuggauucucuggaucagcuucgcaauaucuugcuuucugcuuugugucgcccuguugggguucaucaugugggcuugccagaagggaaauauuagguguaacaucugcauuuga

SEQ ID NO: 127326 - RNA, 1701 nt, Artificial Sequence
  derived and/or modified sequence opt3 from hemagglutinin__InfluenzaA__ADK87293
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggcgcuccaaaaauucauuuuucaguaagcugaacuggcucacucauuuaaauuuuaaguauccagcacugaacgugaccaugcccaauaacgagcaguucgauaaacuuuacauuuggggaguccaccauccuggcacagacaaggaucagaccuuuuuguaugcccaagcuagcggccgaaucacugugucuacaaaacguucccagcagaccgccauuccaaacaucgggucaagacccaggguacggaauauaccuagccgcauuaguaucuacuggacgauuguuaagccaggagacauccugcuaaucaacucuacugguaaucucauugcgccgagaggcuacuucaagauaagguccgggaaaagcucgaucaugcggucugacgcacccauuggaaaguguaacuccgagugcaucacaccuaauggcucaauaccaaacgauaaacccuuucagaaugugaaccgcauuaccuauggugccuguccucgauacgucaagcaaaauacucugaaacuugcuacagggaugagaaacgugccagaaaagcagaccaggggaaucuucggcgccaucgcaggcuuuauugagaaugggugggaaggaaugguggacgguugguauggcuuccggcaccagaacagugaggggcguggacaagcugccgaucugaaaagcacgcaggcggccaucgaccagauuaauggcaaguugaaccgccucauagguaagaccaaugagaaauuccaccagaucgaaaaggaguuuuccgaagucgaggggaggauucaagaucuggaaaaauacguugaggacacaaagaucgauuuauggucuuauaacgcagagcugcucguggcucuugaaaaccagcauacuaucgaccugaccgauagcgagaugucaaaauuguucgaaaagacaaagaaacagcuaagagagaaugccgaagacaugggcaacggaugcuuuaagauuuaccacaaaugugauaaugcuugcauaggcaguauccggaacgggacuuaugaccaugacguauaccgagaugaggcccugaauaaccgcuuccagauuaagggaguggagcucaaauccgguuacaaggacuggauccuguggauuagcuuugcaaucucuugcuuccuucugugugucgccuugcucggcuuuauaaugugggcuugccaaaaggggaauaucagauguaacauuugcaucuga

SEQ ID NO: 127327 - RNA, 1701 nt, Artificial Sequence
  derived and/or modified sequence opt3 from hemagglutinin__InfluenzaA__ADK87295
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcucccuggaguuuaacaaugaaucuuucaacuggacugguguuacacagaaugggaccagcuccgcuugcauccggcgcucaaagaacagcuuuuucagucgacugaauuggcucacgcauuuaaacuuuaaauauccagcacugaaugugacuaugcccaacaacgagcaguucgacaaacuuuacauuuggggaguccaccauccuggcaccgauaaagaccagaucuuuuuguaugcccaggcuucuggccguauuacaguguccacuaagagaucacaacagaccgccaucccaaauauagggagcaggccccggguacgcaacauuccuaguagaaucucuauuuacuggacaaucguuaaaccaggagauauccugcuaauuaauuccaccgguaaccucauagcgccgaggggcuacuucaagauccggagcgggaagucgucuauuaugcgcuccgacgcacccaucggaaaauguaauucagagugcauaacgccuaacggcaguauuccaaaugacaagcccuuucagaacgugaaucgaaucacuuauggugccuguccuagauacgucaaacaaaacacacugaaacuugcuaccgggaugaggaaugugccagaaaagcagacucggggaaucuucggcgccauugcaggcuuuaucgagaacgggugggaaggaaugguggaugguugguauggcuuccgucaccagaauagcgaggggcgcggacaagcugccgaccugaaguccacacaggcggccauugaucagauaaacggcaaauugaauagacucaucgguaagaccaacgagaaguuccaccagauugaaaaagaguuuucugaagucgaggggaggauccaagaccuggaaaaguacguugaggauacgaaaaucgacuuauggagcuauaacgcagagcugcucguggcucuugaaaaucagcauaccauugaucugacagacucagagaugaacaaguuguucgaaaagacuaagaagcagcuacgggagaaugccgaagauaugggcaacggaugcuuuaaaauauaccacaagugugacaaugcuugcaucggcaguauucgaaacgggaccuaugaucaugacguauaccgcgacgaggcccugaauaacagauuccagaucaaaggaguggagcucaaguccgguuacaaagauuggauucuguggaucagcuuugcaauaucuugcuuccuucugugugucgccuugcucggcuuuaucaugugggcuugccaaaaggggaauauuaggcggaacaucuguauuuga

SEQ ID NO: 127328 - RNA, 1701 nt, Artificial Sequence
  derived and/or modified sequence opt3 from hemagglutinin__InfluenzaA__ADK87296
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaaggugcgcuuuugccauggaacggaacgcaggguccggaaucauaauuagcgauaccccggugcaugacuguaauacaaccugccaaacgcccaaaggcgcuaucaacacuucgcucccuuuccagaauauucacccaaucacaaucgguaagugucccaaguacguaaaaucuaccaagcugcgccuugccacugggcugagaaacgugccuuccauucagucaaggggauuguuuggcgcgauagccggcuucaucgaagggggauggacagguauggucgacggcugguauggguaccaucaccagaaugaacaaggaaguggcuaugcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaccaugauucuaauguaaagaaccuguaugagaagguucgaagccagcucaaaaacaaugcaaaggaaaucggcaacggaugcuuugaguucuaccacaagugugacaauacaugcauggaaucagugaaaaacggcacuuaugauuacccaaaguauagugaggaagccaaacugaauagagaggagauugacggggucaaacuugaauccaccaggaucuaccaaauucuggcuauauauagcacaguggcgucuucauugguccucgugguuagucugggagcaaucagcuuuuggaugugcuccaacgguucuuuacagugucggauuugcaucuga

SEQ ID NO: 127329 - RNA, 1701 nt, Artificial Sequence
  derived and/or modified sequence opt3 from hemagglutinin__InfluenzaA__ADK87298
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacagcggaacuugcuauccaggcgauuuuaucgacuacgaggagcucagggagcagcugaguuccgugucuagcuucgaacgguuugagauuuucccgaagacauccucauggcccaaccacgauccuaauaagggugucaccgccgcuuguccacaugcaggggccaaaaguuuuuauaagaaccugaucuggcucgugaaaaagggaaauagcuaccccaaauuaucuaaguccuauauaaacgacaagggcaaagaaguacugguucuuuggggcauccaccacccuucaacgagcgcugaucaacagaguuuguaccagaaugccgacgcguacguguucgucgggacuucucgcuauuccaagaaauuuaagccagagauugcaauccgacccaaagugcgugaucaggagggaagaaugaacuacuauuggacccugguggaaccuggugacaagauuacauucgaggccacuggcaaucuagucguuccaagguacgcuuuugccauggaacggaacgcagggagcggaaacaucauaucggauaccccggugcaugacugcaauacaaccugucaaacgcccaaaggcgcuauuaacacuucucucccuuuccagaauauccacccaauuacaaucgguaagugccccaaguauguaaaauccaccaagcugcgccuugccacugggcugagaaacgugccuucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacgagauuacgaauaaggugaacccaguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuaucccaaguacagugaggaagccaaacugaauagagaggagaucgacggggucaaacuugaauccaccaggauuuaucaaauccuggcuauuuacagcacaguggcgucuucauugguccucgugguuagucugggagcaaucagcuuuuggaugugcuccaacgguucuuuacagugccggauauguauuuga

SEQ ID NO: 127330 - RNA, 1701 nt, Artificial Sequence
  derived and/or modified sequence opt3 from hemagglutinin__InfluenzaA__ADK87300
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcaaaaauuguacccuaauagacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauccggcgcuccaagaacucacuguuuagucgacugaauuggcucacucauuuaaacuucaaauauccagcacugaaugugaccaugcccaacaacgagcaguuugacaaacuuuacauuuggggaguccaccauccuggcacagauaaagaccagaucuucuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuuuaagauccgguccggaaagagcucgauuaugcgcucugacgcacccaucgggaaauguaauuccgagugcauagccccuaacggcucaauuccaaaugacaagaguuuccagaacgugaaucgaaucacuuauggugcuugucccagauacgucaaacaaaacacacugaaacuugccaccgggaugaggaaugugccugaaaagcagacucggggaaucuuuggcgcaauugcuggcuucaucgagaacgggugggaaggaaugguggaugguugguauggcuuucgucaccagaauagcgaggggcgcggacaagccgcggaccugaaguccacacaggccgcaauugaucagauaaacggcaaauugaauagacucaucgguaagaccaacgagaaguuccaccagauugaaaaagaguucucugaagucgaggggaggauccaagaccuggaaaaguacguugaggauacgaaaaucgacuuauggagcuauaacgcugagcugcucguggcccuugaaaaucagcauaccauugaucugacagacucagagaugaacaaguuguuugaaaagacuaagaagcagcuacgggagaaugcugaagauaugggcaacggaugcuucaaaauauaccacaagugugacaaugccugcaucggcaguauucgaaacgggaccuaugaucaugacguauaccgcgacgaggcacugaauaacagauuucagaucaaaggaguggagcucaaguccgguuacaaagauuggauucuguggaucagcuucgccauaucuugcuuucuucugugugucgcuuugcucggcuucaucaugugggcgugccaaaaggggaauauuagguguaacaucugcauuuga

SEQ ID NO: 127331 - RNA, 1701 nt, Artificial Sequence
  derived and/or modified sequence opt3 from hemagglutinin__InfluenzaA__ADK87302
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcaaaaauuguacccuaauagacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauccggcgcuccaagaacucauuuuucagucgacugaauuggcugacucaucucaacuuuaaauauccagcauuaaaugugaccaugcccaacaacgagcaguucgacaagcuguacauuuggggaguccaccauccuggcacagauaaagaccagaucuuucuuuaugcccaagcuagcggccguauuacugugucuaccaagagaucccagcagacagccaucccaaauauagggucaaggccccggguacgcaacauuccuagcagaaucaguauuuacuggaccaucguuaaaccaggagauaucuugcugauuaauucuacggguaaccuaauagcgccgaggggcuacuucaagauccgguccgggaaaagcucgauuaugcgcucugacgcacccaucggaaaauguaauuccgagugcauaacuccuaacggcucaauuccaaaugacaagcccuuucagaacgugaaucgaaucacauauggugccuguccuagauacgucaaacaaaacacccucaagcuggcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaacugaauagauugaucgguaagacgaacgagaaguuccaccagauugaaaaagaguuuuccgaagucgaggggaggauccaagaccucgaaaaguacguugaggauaccaaaaucgaccuguggucuuauaacgcagaguuacugguggcucucgaaaaucagcauacaauugaucuuacugacagcgagaugaacaagcuguucgaaaagaccaagaagcaguugcgggagaaugccgaagauaugggcaacggaugcuuuaaaauauaccacaagugugacaaugcuugcaucggcucaauucgaaacgggacauaugaucaugacguauaccgcgacgaggcccuaaauaacagauuccagaucaaaggaguggagcugaagagugguuacaaagauuggauucucuggaucuccuuugcaauaagcugcuuccugcuuugugucgcccuguugggcuuuaucaugugggcuugccaaaaggggaauauuaggugugacaucugcauuuga

SEQ ID NO: 127332 - RNA, 1701 nt, Artificial Sequence
  derived and/or modified sequence opt3 from hemagglutinin__InfluenzaA__ADK87304
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauucggcgcuccaagaacucauuuuucagucgacugaauuggcugacucaucucaacuuuaaauauccagcauuaaaugugaccaugcccaacaacgagcaguucgacaagcuguacaucuggggaguccaccauccuggcacagauaaagaccagauuuuucuuuaugcccaagcuagcggccguaucacugugucuaccaagagaucccagcagacagccauaccaaauauugggucaaggccccggguacgcaacaucccuagcagaauuaguaucuacuggaccaucguuaaaccaggagauauuuugcugauaaauucuacggguaaccuaaucgcgccgaggggcuacuucaagauucgguccggaaagagcucgaucaugcgcucugacgcacccauagggaaauguaauuccggcugcauuacuccuaacgguucaaucccaaaugacaagcccuuucagaacgugaaucgaaucacauauggggccuguccuagauacgucaaacaaaacacccucaagcuggcuacuggaaugaggaaugugccagagaaacagacacggggcauuuucggcgccaucgcaggguuuauugaaaacggaugggaggguaugguggauggcugguauggguuccgucaccagaauagugaaggacgcggccaagcugccgaccuuaagagcacccaggcggccauagaucagaucaacgguaaacugaauagauugauugggaagacgaacgagaaguuccaccagaucgagaaagaauuuuccgaggucgaaggcaggauccaagaccucgagaaguacguugaagauaccaaaauugaccuguggucuuauaacgcagaguuacugguggcucucgagaaucagcauacaauagaucuuacugacagcgaaaugaacaagcuguucgagaaaaccaagaagcaguugcgggaaaaugccgaggauaugggaaacggcugcuuuaaaaucuaccacaagugugacaaugcuugcauugggucaauccgaaacggaacauauggucaugauguauaccgcgacgaagcccuaaauaacagauuccagauuaaaggcguggagcugaagaguggguacaaagacugguuucucuggaucuccuucgcaauaagcugcuuucugcuuugugucgcccuguugggauucaucaugugggcuugccaaaagggcaauauuagguguaacaucugcauuuga

SEQ ID NO: 127333 - RNA, 1701 nt, Artificial Sequence
  derived and/or modified sequence opt3 from hemagglutinin__InfluenzaA__ADK87306
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcggcugaacugguacagucuucaaguaccggugagauuugcgacagcccacaccagauccuagauggcaaaaauuguacacucauagacgcccugcuuggggauccgcagugcgacggauuucaaaacaagaaaugggaucuguucgugggcagauccaaggcauauucuaauuguuaccccuaugacgucccugauuacgccucguugaggucacucguggcuagcagugguacccuggaauuuaacaaugaguccuucaacuggacugggguuacacagaauggaaccucuagcgcaugcauccggcgcuccaagaacucauuuuucagucgacugaauuggcucacgcauuuaaacuuuaaauauccagcccugaaugugacuaugcccaacaacgaacaguucgacaagcuguacauuuggggcguccaccauccuggcaccgauaaagaccagaucuuuuuguaugcucaagccagcgggcguauuacagugucuacuaagagaucccagcagaccgcgaucccaaauauaggaucaaggccccggguacgcaacauuccuagcagaaucaguauuuacuggacaaucguuaaaccaggugauauccugcuaauuaauucuaccggcaaccucauagcaccgaggggguacuucaagauccgguccggaaagagcucgauuaugcgcucugacgcccccaucggcaaauguaauuccgagugcauaacgccuaacgguucaauuccaaaugacaagcccuuucagaacgugaaucgaaucacuuauggggcuuguccuagauacgucaaacaaaacacacugaaacuugccaccggagugaggaaugugccagagaagcagacucggggcaucuucggcgcaauugcuggguuuaucgaaaacggaugggaggguauggucgauggcugguauggguuccgucaccagaauagugaaggacgcggccaagccgcggaccuuaagagcacacaggccgcaauggaucagauuaacgguaaauugaauagacucauagggaagaccaacgagaagcugcaccagacggagaaagaguucuccgaaguugaaggcaggauccaagacuuagagaaguacguggaagauaccaaaauugaccuguggucuuauaacgcugagcuccuuguagcccuggagagccagcauacaaucgauuugacugacucagaaaugaauaagcuauuugagaaaaccaagaagcagcugcgggaaaacgcugaggauaugggaaauggcugcuucaaaaucuaccacaagugugacaacgccugcauugggaguauacgaaauggaacauaugaucaugacguguaccgcgacgaagcacucaacaauagauuucagaucaaaggugucgagcugaaguccggcuacaaagauuggauucuuuggaucagcuucgccauuucuugcuuucuguuguguguggcucuccugggguucaucaugugggcgugccaaaagggaaacauaagguguaauaucugcauuuga

SEQ ID NO: 127334 - RNA, 1701 nt, Artificial Sequence
  derived and/or modified sequence opt3 from hemagglutinin__InfluenzaA__ADK87308
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcaaaaauuguacccuaauagacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauccggcgcuccaagaacucauuuuucagucgacugaauuggcugacucaucucaacuuuaaauauccagcauuaaaugugaccaugcccaacaacgagcaguucgacaagcuguacauuuggggaguccaccauccuggcacagauaaagaccagaucuuucuuuaugcccaagcuagcggccguauuacugugucuaccaagagaucccagcagacagccaucccaaauauagggucaaggccccggguacgcaacauuccuagcagaaucaguauuuacuggaccaucguuaaaccaggagauaucuugcugauuaauucuacggguaaccuaauagcgccgaggggcuacuucaagauccgguccgggaaaagcucgauuaugcgcucugacgcacccaucggaaaauguaauuccgagugcauaacuccuaacggcucaauuccaaaugacaagcccuuucagaacgugaaucgaaucacauauggugccuguccuagauacgucaaacaaaacacccucaagcuggcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaacugaauagauugaucgguaagacgaacgagaaguuccaccagauugaaaaagaguuuuccgaagucgaggggaggauccaagaccucgaaaaguacguugaggauaccaaaaucgaccuguggucuuauaacgcagaguuacugguggcucucgaaaaucagcauacaauugaucuuacugacagcgagaugaacaagcuguucgaaaagaccaagaagcaguugcgggagaaugccgaagauaugggcaacggaugcuuuaaaauauaccacaagugugacaaugcuugcaucggcucaauucgaaacgggacauaugaucaugacguauaccgcgacgaggcccuaaauaacagauuccagaucaaaggaguggagcugaagagugguuacaaagauuggauucucuggaucuccuuugcaauaagcugcuuccugcuuagggucgcccuguugggcuuuaucaugugggcuugucaaaaggggaauauucggugcaacaucuguauuuga

SEQ ID NO: 127335 - RNA, 1701 nt, Artificial Sequence
  derived and/or modified sequence opt3 from hemagglutinin__InfluenzaA__ADK87309
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauugaucugacugacagcgagaugaacaaguuguucgaaaagaccaagaagcagcuacgggagaaugccgaagauaugggcaacggaugcuuuaaaauauaccacaagugugacaaugcuugcaucggcucaauucgaaacgggacauaugaucaugacguauaccgcgacgaggcccugaauaacagauuccagaucaaaggaguggagcucaagagugguuacaaagauuggauucuguggaucuccuuugcaauaagcugcuuccuucugugugucgccuugucuggcuuuaucaugugggcuugccaaaaggggaauauuagguguaacaucugcauuuga

SEQ ID NO: 127336 - RNA, 1701 nt, Artificial Sequence
  derived and/or modified sequence opt3 from hemagglutinin__InfluenzaA__ADK87310
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacagguagcuggcccaaucacgauccuaacaagggggucaccgccgcuuguccacaugcaggagccaaauccuuuuauaagaaucugaucuggcucgugaaaaagggcaacucauaccccaaauuaaguaagagcuauauaaaugacaagggcaaagaaguacugguucuuugggggauccaccacccuucuacguccgcugaucaacagucauuguaccagaacgccgacgcguacguguucgucggaacuagccgcuauaguaagaaauuuaagccagagauugcaauccgacccaaagugcgugaucaggaggguagaaugaauuacuauuggacccugguggaaccuggcgacaagauuacauucgaggccacugggaaccuagucguuccaagguacgcuuuugccauggaacggaacgcaggaucuggcaucauaauuuccgauaccccggugcaugacugcaauacaaccugucaaacgcccaaaggugcuaucaacacuagccucccuuuccagaauauucacccaaucacaaucgggaagugccccaaguauguaaaaucgaccaagcugcgccuugccacuggacugagaaacgugccuucuauucaguccaggggcuuguuuggcgcgauagccggguucaucgagggagguuggacaggcauggucgacgggugguacggauaucaucaccagaaugaacaaggcucagguuacgcagcugaucucaaaaguacccagaacgccauugacgagaucacgaauaaggugaacagcguuauagagaaaaugaauacccaguuuacagcuguggggaaggaguucaaccaccuggagaagcggauugaaaauuuaaacaaaaaggucgaugacggcuuccuggauaucuggacuuacaaugccgagcuccuugugcuguuggaaaacgagcgcacccuagacuaucaugauuccaauguaaagaaccuguacgagaagguucgaucucagcucaaaaacaaugcaaaggaaaucggaaacggcuguuuugaguucuaucacaagugcgacaauacauguauggaaagcgugaaaaacgggacuuacgauuauccaaaguacucagaggaagccaaacugaauagagaggagauugacggagucaaacuugaaaguaccaggaucuaucaaauucuggcuauauacuccacaguggcgagcucuuugguccucgugguuucacugggugcaaucaguuuuuggaugugcagcaacggcuccuuacagugccggauuuguaucuga

SEQ ID NO: 127337 - RNA, 1701 nt, Artificial Sequence
  derived and/or modified sequence opt3 from hemagglutinin__InfluenzaA__ADK87311
augaaggccauccuggugguccuccuuuacaccuucgcuacagcaaacgccgacacucugugcauuggcuaucacgcggauaauagcacggacaccguugauacaguguuggagagaaacguaacugugacccauuccgucaauuuacuggaagacaaacacaacgggaagcuauguaaacucaggggaguggcuccccugcaucuugguaagugcaauauagccggcuggauccuggggaacccugagugugaaucuuugucaacagcaaguagcugguccuacauuguugagaccucuucgucagauaauggaacuugcuauccaggcgacuuuaucgauuacgaagaacuccgggagcagcugagcaguguguccucuuucgaacgcuuugagauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggaaguacugguucuuuggggcauccaccaccccucaacgagcgcugggcaacagaguuuguaccagaaugccgacgcguacguguucgucggaacuucucgauauuccaaaaaguuuaaaccugagauugcaauccguccaaaggugagagaucaggaggguaggaugaacuacuauuggacccugguggaacccggcgacaaaauuacauucgaggccacugggaaucuagucguuccucgguacgcuuuugccauggaacgcaacgcaggaagcggcaucauaauuucggauaccccagugcaugacugcaacacaaccugucaaacgccgaagggugcuaucaauacuucucccccuuuccagaacauucacccaaucacaaucgggaaaugccccaaguauguaaaguccaccaaacucagacuggccacuggacuuaggaaugugccuucaauucagagucggggccuguuuggcgcgauagccggguucaucgagggagguuggacaggcauggucgacgggugguacggauaucaucaccagaacgaacaaggcagcgguuacgcagcugauuugaaguccacccagaaugccauugacgagaucacgaacaaaguuaauucugugauagagaagaugaacacccaguuuacagcuguggggaaagaguucaaucaccucgagaagcgcauugaaaaccugaauaagaaagucgaugacggcuucuuagauaucuggacuuacaacgccgagcugcucgugcuucuggaaaaugagcgaaccuuggacuaucaugauagcaacguaaagaaucuauacgagaaaguuagaucacagcugaagaacaacgcaaaagaaaucggaaauggcuguuuugaguucuaucacaagugcgacaacacauguauggaaagugugaagaaugggacuuacgauuauccaaaauacuccgaggaagccaagcucaacagggaggagauugacggagucaaacuggaaagcacccggaucuaucaaauucuugcuauauacucuacaguggcgucaagucuggucuuggugguuagccucggugcaaucuccuuuuggaugugcucuaauggcucgcugcagugccguauuuguaucuga

SEQ ID NO: 127338 - RNA, 1701 nt, Artificial Sequence
  derived and/or modified sequence opt3 from hemagglutinin__InfluenzaA__ADK87313
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauucggcgcuccaagaacucauuuuucagucgacugaauuggcugacucaucucaacuuuaaauauccagcauuaaaugugaccaugcccaacaacgagcaguucgacaagcuguacaucuggggaguccaccauccuggcacagauaaagaccagauuuuucuuuaugcccaagcuagcggccguaucgccgugucuacuaagagaucccagcagaccgcgauaccaaauauugggucaaggccccggguacgcaacaucccuagcagaauuaguaucuacuggacaaucguuaaaccaggagauauuuugcugauaaauucuaccgguaaccuaaucgcaccgaggggcuacuucaagauucgguccggaaagagcucgaucaugcgcucugacgcccccauagggaaauguaauuccggcugcauuacgccuaacgguucaaucccaaaugacaagcccuuucagaacgugaaucgaaucacuuauggggcuuguccuagauacgucaaacaaaacacacucaagcuggccaccggaaugaggaaugugccagagaaacagacucggggcauuuucggcgcaaucgcuggguuuauugaaaacggaugggaggguaugguggauggcugguauggguuccgucaccagaauagugaaggacgcggccaagccgcggaccuuaagagcacacaggccgcaauagaucagaucaacgguaaacugaauagauugauugggaagaccaacgagaaguuccaccagaucgagaaagaauuuuccgaggucgaaggcaggauccaagaccucgagaaguacguugaagauacgaaaauugaccuguggucuuauaacgcugaguuacugguggcccucgagaaucagcauaccauagaucuuacagacagcgaaaugaacaagcuguucgagaaaacuaagaagcaguugcgggaaaaugcugaggauaugggaaacggcugcuuuaaaaucuaccacaagugugacaaugccugcauugggucaauccgaaacggaaccuaugaucaugacguauaccgcgacgaagcacuaaauaacagauuccagauuaaagguguggagcugaagaguggcuacaaagauugguuucucuggaucuccuucgccauaagcugcuuucugcuuugugucgcucuguugggguucaucaugugggcgugccaaaagggaaauauuagguguaacaucugcauuuga

SEQ ID NO: 127339 - RNA, 1701 nt, Artificial Sequence
  derived and/or modified sequence opt3 from hemagglutinin__InfluenzaA__ADK87315
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagccccuggccuaaucacgauccaaacaagggugucaccgccgcuuguccccaugcaggggccaaauccuuuuauaagaaucugaucuggcucgugaaaaagggaaacucauacccuaaauuaaguaagagcuauauaaaugacaagggcaaagaaguacugguucuuuggggcauccaccacccaucuacguccgcugaucaacagucauuguaccagaacgccgacgcguacguguucgucgggacuagccgcuauaguaagaaauuuaagcccgagauugcaauccgaccuaaagugcgugaucaggagggaagaaugaauuacuauuggacccugguggaaccaggugacaagauuacauucgaggccacuggcaaccuagucguuccgagguacgcuuuugccauggaacggaacgcagggucuggaaucauaauuuccgauacccccgugcaugacugcaauacaaccugucaaacgccuaaaggcgcuaucaacacuagccucccauuccagaauauucaccccaucacaaucgguaagugcccuaaguauguaaaaucgaccaagcugcgccuugccacugggcugagaaacgugccaucuauucaguccaggggauuguuuggcgcgauagccggcuucaucgaagggggauggacagguauggucgacggcugguacggguaucaucaccagaaugaacaaggaucaggcuacgcagcugaucucaaaaguacccagaacgccauugacgagaucacgaauaaggugaacagcguuauagagaaaaugaauacccaguuuacagcuguggguaaggaauccaaccaccuggagacucggauugaaaauuuaaacaagaaagucgaugacggguuccuggauaucuggaccuacaaugccgagcuccuugugcuguuggaaaacgagcgcacacuagacuaucaugauucuaauguaaagaaccuguacgagaaaguucgaagccagcucaagaacaaugcaaaagaaaucggcaacggauguuucgaguuuuaucacaagugcgacucaacuuguauggaaagugugaagaauggcaccuacgauuaucccaaauacuccgaggaagccaagcugaacagagaggagauugacggggucaaacuugaaagcacaaggaucuaucaaauucuggcuauauacucuaccguggcgucaaguuugguccucgugguuagccugggagcaaucuccuucuggaugugcucuaaugguucguuacagugccggauuuguaucuga

SEQ ID NO: 127340 - RNA, 1701 nt, Artificial Sequence; identical to SEQ ID NO: 125483
  derived and/or modified sequence opt3 from hemagglutinin__InfluenzaA__ADK87317

SEQ ID NO: 127341 - RNA, 1701 nt, Artificial Sequence
  derived and/or modified sequence opt3 from hemagglutinin__InfluenzaA__ADK87319
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccgagcugcgccuugccacugggcugagaaacgugccuuccauucagucaaggggauuguuuggcgcgauagccggcuucaucgaagggggauggacagguauggucgacggcugguacggguaucaucaccagaaugagcaaggaaguggcuacgcagcugaucucaagagcacccagaacgccauugacgagaucacgaauaaagugaacuccguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauucuaauguaaagaaccuguacgaaaaaguucgaagccagcucaagaacaaugcaaaagagaucggcaacggauguuuugaguucuaucacaagugcgacaauacauguauggagucagugaagaacggcacuuacgauuauccaaaauacagugaagaggccaagcugaauagagaggaaauugacggggucaaacuugaguccaccaggaucuaucggauucuggcuauauacagcacaguggcgucuucauugguccucgugguuagucugggagcaaucagcuuuuggaugugcuccaacgguucuuuacaaugccguauuuguaucuga

SEQ ID NO: 127342 - RNA, 1701 nt, Artificial Sequence
  derived and/or modified sequence opt3 from hemagglutinin__InfluenzaA__ADK87321
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcaugcggcgcuccaagaacucauuuuucagucgacugaauuggcugacucaucucaacuuuaaauauccagcauuaaaugugaccaugcccaacaacgagcaguucgacaagcuguacauuuggggaguccaccauccuggcacagauaaagaccagaucuuucuuuaugcccaagcuagcggccguauuacugugucuaccaagagaucccagcagacagccaucccaaauauagggucaaggccccggguacgcaacauuccuagcagaaucaguguuuacuggaccauugugaaaccaggagauaucuugcugaucaauucuacggguaaccuaauugcgccgaggggcuacuucaagauacgguccggaaagagcucgaucaugcgcucugacgcauccauugggaaauguaauucaggcugcaucacucccaacgguaguauaccuaaugacaagccauuucagaacgucaaucgaauuacauauggggccugucccagauacgugaaacaaaacacccucaagcuggcuacuggaaugaggaaugugccugagaaacagacacggggcaucuucggcgccaucgcaggguuuauugaaaacggaugggaggguauggucgauggcugguauggguuccgucaccagaauagcgaaggacgcggccaagcugccgaccuuaaguccacccaggcggccaucgaucagauuaacgguaaacugaauagauugauagggaagacgaacgagaaguuccaccagaucgagaaagaauuuccagagguugaaggcaggauucaagaccucgagaaguacguggaagauaccaaaaucgaccuguggucuuauaacgcagagcccuuaguagcucuggagaaucagcauacaaucgaucucacugacagcgaaaugaacaaacuuuucgagaagaccaagaagcagcugcgggaaaaugccgaggauaugggaaacggcugcuuuaaaauuuaccacaagugugacaaugcuugcauagggucaauccgaaacggaacauaugaucaugacguguaccgcgacgaagccuugaauaacagauuccagauuaaaggugucgagcuaaagaguggcuacaaagauugguuucuguggaucuccuucgcaauuagcugcuuucuccuguguguggcccuucugggguucaucaugugggcuugccaaaagggaaauauaagguguaacaucugcauuuga

SEQ ID NO: 127343 - RNA, 1701 nt, Artificial Sequence
  derived and/or modified sequence opt3 from hemagglutinin__InfluenzaA__ADK87323
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguaggaaacauuccuagccgcaucaguauuuacuggaccaucguuaaaccaggugauauccugcuaauuaauucuacgggcaaccucauagcgccgagaggguacuucaagaucagguccggaaagagcucgauuaugcggucugacgcacccaucggcaaauguaauuccgagugcauaacuccuaacgguucaauuccaaaugacaagcccuuucagaacgugaaucgcaucacauauggggccuguccucgauacgucaaacaaaacacccugaaacuugcuacuggaaugagaaaugugccagaaaaacagacaaggggcaucuucggcgccauugcaggguuuaucgagaacggaugggaagguaugguggauggcugguauggguuccggcaccagaauagugagggacguggccaagcugccgaccuuaagagcacccaggcggccauugaucagauaaacgguaaauugaaucgccucaucgggaagacgaacgagaaguuccaccagauugaaaaagaguuuuccgaagucgagggcagaauccaagaccuggaaaaguacguugaggauaccaaaaucgacuuauggucuuauaacgcagagcugcucguggcucuugaaaaucagcauacaauugaucugacugacagcgagaugaacaaguuguucgaaaagaccaagaagcagcuaagggagaaugccgaagauaugggaaacggcugcuuuaaaauauaccacaagugugacaaugcuugcaucgggucaauucggaacggaacauaugaucaugacguauaccgagacgaggcccugaauaaccgcuuccagaucaaagguguggagcucaagaguggcuacaaagauuggauucuguggaucuccuuugcaauaagcugcuuccuucugugugucgccuugcucggguuuaucaugugggcuugccaaaagggaaauauuagauguaacaucugcauuuga

SEQ ID NO: 127344 - RNA, 1701 nt, Artificial Sequence
  derived and/or modified sequence opt3 from hemagglutinin__InfluenzaA__ADK87325
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagacacgucaaacaaaacacccugaaacuugcuacugggaugaggaaugugccagaaaaacagacacggggaaucuucggcgccauugcaggcuuuaucgagaacgggugggaaggaaugguggaugguugguacggcuuccgucaccagaauagugaggggcgcggacaagcugccgaccuuaagagcacccaggcggccauugaucagauaaacggcaaauugaauagacucaucgguaagacgaacgagaaguuccaucagauugaaaaagaguuuuccgaagucgaggggaggauccaagaccuggaaaaguauguugaggauaccaaaaucgacuuauggucuuacaacgcagagcugcucguggcucuugaaaaucagcacacaauugaucugacugacagcgagaugaacaaguuguucgaaaagaccaagaagcagcuacgggagaaugccgaagauaugggcaacggaugcuuuaaaauauaucauaagugugacaaugcuugcaucggcucaauucgaaacgggacauacgaucacgacguauaucgcgacgaggcccugaauaacagauuccagaucaaaggaguggagcucaagagugguuacaaagauuggauucuguggaucuccuuugcaauaagcugcuuccuucugugugucgccuugcucggcuuuaucaugugggcuugccaaaaggggaauauuagguguaacaucugcauuuga

SEQ ID NO: 127345 - RNA, 1701 nt, Artificial Sequence
  derived and/or modified sequence opt3 from hemagglutinin__InfluenzaA__ADK87326
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauugaucugacugacagcgagaugaacaaguuguucgaaaagaccaagaagcagcuacgggagaaugccgaagauaugggcaacggaugcuuuaaaauauaccacaagugugacaaugcuugcaucggcucaauucgaaacgggacauaugaucaugacguauaccgcgacgaggcccugaauaacagauuccagaucaaaggaguggagcucaagagugguugcaaagauuggauucuguggaucuccuuugcaauaagcuguuuccuucugugcgucgccuugcucggcuuuacuaugugggcuugucaaaaggggaauaucaggugcaacauuuguaucuga

SEQ ID NO: 127346 - RNA, 1701 nt, Artificial Sequence
  derived and/or modified sequence opt3 from hemagglutinin__InfluenzaA__ADK87328
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaucggcuaucaacacuucucucccuuuccagaauauucacccaaucacaaucggcaagugccccaaguauguaaaauccaccaagcugcgccuugccacuggucugagaaacgugccuucaauucagaguaggggguuguuuggagcgauagccggcuucaucgagggcggguggacaggaauggucgacgguugguacggcuaucaucaccagaaugaacaagggagcggauacgcagcugaucucaaauccacccagaacgccauugacgagaucacgaauaaggugaacucuguuauagagaaaaugaauacccaguuuacagcugugggcaaggaguucaaccaccuggagaagcggauugaaaauuuaaacaaaaaggucgaugacgguuuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucgggaacggcuguuuugaguucuaucacaagugcgacaauacauguauggaaagugugaaaaacggaacuuacgauuauccaaaguacuccgaggaagccaaacugaauagagaggagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 127347 - RNA, 1701 nt, Artificial Sequence
  derived and/or modified sequence opt3 from hemagglutinin__InfluenzaA__ADK87334
augaagaccaucauugcccugagcuacauacucugccuuguguucgcucagaaacugcccggcaacgacaauuccacagcaacuuuguguuuagggcaccaugccgucccuaacggaacgaucguuaagaccauuacaucugaucaaaucgaggugacuaaugcgaccgaacugguacagucaaguagcacaggugagauuugcgacuccccacaccagauccuagauggcaaaaacuguacccucauagacgcucugcuuggggauccgcagugcgacggauuucaaaauaagaaaugggaucuguucguggaaagaucuaaggccuauucgaacuguuaccccuaugacgucccugauuacgcaucauugaggagccucguggccaguuccggcacucuggaguuuaauaacgaaucuuucaauuggacagguguuacccagaacgggacgagcuccgcuugcauccggcgcucaaagaauagcuuuuucaguaaacugaacuggcucacucauuuaaauuuuaaguauccagcacugaacgugaccaugcccaauaacgagcaguucgacaaacuuuacauuuggggaguccgacacccuggcacagauaaggaccagaucuuuuuguaugcccaggcuucuggccguauuacuguguccaccaaaagaucacaacagacaguaaucccaaacauagggagcaggccccggguucgcaauauuccuaguagaaucucuaccuacuggacgauugugaagccaggagauauccugcuaaucaacuccacugguaaucucauugccccgaggggcuacuucaagauacggagcgggaaaucgucuaucaugcgcuccgacacacccauuggaaaguguaacucagagugcaucaccccuaauggcaguauaccaaacgacaaacccuuucagaaugucaaccgaauuacuuauggugcguguccuagauacgugaagcaaaauacacugaaacuugcaaccgggaugaggaacgugccagaaaagcagacgcggggaaucuucggcgccaucgcuggcuuuauugagaaugggugggaaggaauggucgaugguugguauggcuuccgucaucagaacagcgaggggcgcggacaagccgcagaccugaaauccacccaggcugccaucgaucagauuaauggcaaguugaacagacucauagguaagacaaaugagaaauuccaccagaucgaaaaggaguuuucugaaguugaggggaggauucaagaccuggaaaaauacguggaggauacuaagaucgacuuauggagcuauaacgcggagcugcucguagcccuugaaaaccagcacaccaucgaucugacagacucagagaugaauaaauuguucgaaaagacuaagaaacagcuacgggagaacgcagaagauaugggcaauggaugcuuuaagauuuaccauaaaugugacaacgcuugcauaggcaguauccgaaaugggaccuaugaucacgacguguaccgcgacgaggcccugaacaauagauuccagauuaagggagucgagcucaaauccgguuacaaggauuggauccuguggauuagcuuugcuaucucuugcuuccuucuguguguggccuugcucggcuuuauaaugugggcaugccaaaaggggaacaucagguguaauauuugcaucuga

SEQ ID NO: 127348 - RNA, 1701 nt, Artificial Sequence
  derived and/or modified sequence opt3 from hemagglutinin__InfluenzaA__ADK87336
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucaguaaacugaauuggcucacucauuuaaacuuuaaguauccagcacugaaugugaccaugcccaacaacgagcaguucgacaaacuuuacauuuggggaguccaccauccuggcacagaucgagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacacucccaucgggaaauccaauucagaguguauaacaccuaacggcaguauuccaaaugacaagcccuuucagaacgucaaucgaaucaccuauggugcgugcccuagauacgugaaacaaaacacucugaaacuugcaacagggaugaggaaugugccagaaaaacagacccggggaaucuucggcgccauugcuggcuuuaucgagaacgggugggaaggaauggucgaugguugguauggcuuccgucaccagaauagcgaggggcgcggacaagccgcagaccugaaguccacgcaggcugccauugaucagauaaacggcaaauugaauagacucaucgguaagaccaacgagaaguuccaccagauugaaaaagaguuuucugaaguugaggggaggauccaagaccuggaaaaguacguggaggauacaaaaaucgacuuauggagcuauaacgcggagcugcucguagcccuugaaaaucagcauacuauugaucugaccgacucagagaugaacaaguuguucgaaaagacaaagaagcagcuacgggaggaugcagaagacaugggcaauggauguuuuaaaauauaccacaagugcgauaacgcuuguaucggcaguauucgaaaugggacuuaugaccaugacguguaccgcgaugaggcccugaacaauagauuccagaucaaaggagucgagcucaaguccgguuacaaagacuggauucuguggaucagcuuugcuauaucuugcuuccuucugugcguggccuugcucggcuuuaucaugugggcaugucaaaaggggaacauuaggugcaauaucuguauuuga

SEQ ID NO: 127349 - RNA, 1701 nt, Artificial Sequence; identical to SEQ ID NO: 124685
  derived and/or modified sequence opt3 from hemagglutinin__InfluenzaA__ADK87338

SEQ ID NO: 127350 - RNA, 1701 nt, Artificial Sequence
  derived and/or modified sequence opt3 from hemagglutinin__InfluenzaA__ADK90193
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaaguaguucuggugcuuuggggcauccaccaccccucaacgagcgcugaucaacagaguuuguaccagaacgccgacgcguacgucuucguggggacuucucgcuauuccaagaaauuuaagccugaaauugcaauccgaccaaaagugcgugaucaggagggaagaaugaauuacuauuggacccuggucgagcccggugacaagauuacauucgaagccacuggcaaccuaguugugccuagguacgcuuuugccauggagcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacgaaaucacgaauaagguuaacucugugauagagaaaaugaauacccaguuuacagcugucgguaaggaguucaaccaccuggaaaagcggauugagaauuuaaacaaaaagguggaugacggguuccuggauaucuggacuuacaaugccgaacuccuuguacuguuggagaacgaacgcacccuagacuaucaugauagcaauguuaaaaaccuguacgagaaggugcgaucacagcucaaaaacaaugcaaaggagaucggcaacggauguuuugaguucuaucacaagugcgacaauacauguauggagagugucaaaaacggcacuuacgauuauccuaaguacuccgaagaggccaaacugaauagagaagagauugacggggugaaacuugagagcaccaggaucuaucaaauucuggcuauauacucuacagucgcgucaaguuuggugcucguugugagccugggagcaaucuccuuuuggaugugcucuaacgguucguuacagugccggauuuguaucuga

SEQ ID NO: 127351 - RNA, 1701 nt, Artificial Sequence
  derived and/or modified sequence opt3 from hemagglutinin__InfluenzaA__ADK90194
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaaaucgaugacggguuccuggauaucuggacuuacaaugccgagcuccuuguccuguuggaaaacgagcggacccuagacuaucaugauagcaaugugaagaaccuguacgagaaaguacgcucacagcucaagaacaaugcaaaggaaauuggcaacggauguuucgaguucuaucacaaaugcgacaauacauguauggaaaguguuaagaacggcacuuacgauuauccuaaauacuccgaggaagccaagcugaaucgagaggagaucgacggggugaaacuugaaagcaccagaauuuaucaaauacuggcuaucuacucuacagucgcgucaaguuuggugcucgucgugagccugggagcaauuuccuuuuggaugugcucuaacgguucguuacagugcaggaucuguaucuga

SEQ ID NO: 127352 - RNA, 1701 nt, Artificial Sequence
  derived and/or modified sequence opt3 from hemagglutinin__InfluenzaA__ADK90195
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucgugauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagauugaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127353 - RNA, 1701 nt, Artificial Sequence; identical to SEQ ID NO: 124672
  derived and/or modified sequence opt3 from hemagglutinin__InfluenzaA__ADK90196

SEQ ID NO: 127354 - RNA, 1701 nt, Artificial Sequence
  derived and/or modified sequence opt3 from hemagglutinin__InfluenzaA__ADK90197
augagagccauccugggcgugcuccuuuacaccuucgcuacagcaaacgccgacacucugugcauuggguaucacgcgaauaacagcacggauaccgucgacacaguuuuggagaagaaugugacuguaacccauuccgugaacuuacuggaagauaaacacaauggaaagcuauguaaacucaggggugucgcuccccugcaucuuggcaagugcaacauagccggguggauccugggaaauccugagugugaaucuuugucaacagcaaguagcugguccuacauuguggagaccucuucgucagacaacggcacuugcuauccaggugauuuuaucgacuacgaagaacuccgggagcagcugagcaguguuuccucuuucgaacgcuuugagauuuucccgaaaacaagcuccuggcccaaucacgauucaaacaagggggugaccgccgcuuguccucaugcaggagccaagaguuuuuauaaaaaucugaucuggcucgucaagaaaggcaacagcuacccaaaguuaucuaaauccuauauaaaugacaagggcaaggaagugcugguacuuugggggauccaccaccccucaacgagcgcugaucaacagaguuuguaccagaacgccgacgcguacguuuucgugggaacuucucgauauuccaaaaaguuuaaaccugagauugcaauccguccaaaggucagagaucaggaggguaggaugaauuacuauuggacccugguggaacccggcgacaaaauuacauucgaggccacugggaaccuaguggucccucgguacgcuuuugccauggaacgcaacgcaggaagcggcaucauaauuucggauaccccaguucaugacugcaauacaaccugucaaacgccgaagggugcuaucaacacuucucuccccuuccagaauauucacccuaucacaaucgggaaaugcccaaaguaugugaaguccaccaaacugagacuugccacuggacugaggaacguacccucaauucagagucggggcuuguuuggcgcgauagccggguucaucgagggagguuggacaggcaugguggacgggugguacggauaucaucaccagaaugaacaaggcagcgguuacgcagcugaucucaaguccacccagaacgccauugacgagaucacgaauaaagucaacucugugauagagaagaugaauacccaguuuacagcuguugggaaagaguucaaccaccuggagaagcgcauugaaaauuuaaacaagaaaguggaugacggcuuccuggauaucuggacuuacaaugccgagcuccuuguccuguuggaaaacgagcgaacccuagacuaucaugauagcaaugugaagaaccuguacgagaaaguaagaucacagcucaagaacaaugcaaaagaaaucggaaacggcuguuuugaguucuaucacaagugcgacaauacauguauggaaaguguuaagaacgggacuuacgauuauccuaaauacuccgaggaagccaagcugaauagggaggagauugacggagugaaacuugaaagcacccggaucuaucaaauucuggcuauauacucuacagucgcgucaaguuuggugcucgucgugagccugggugcaaucuccuuuuggaugugcucuaacggcucguuacagugccguauuuguaucuga

SEQ ID NO: 127355 - RNA, 1701 nt, Artificial Sequence
  derived and/or modified sequence opt3 from hemagglutinin__InfluenzaA__ADK90198
augaaggccauccugggcgugcuccuuuacaccuucgcuacagcaaacgccgacacucugugcauuggguaucacgcgaauaacagcacggauaccgucgacacaguuuuggagaagaaugugacuguaacccauuccgugaacuuacuggaagauaagcacaauggaaaacuauguaagcucagaggugucgcuccccugcaucuuggcaaaugcaacauagccggguggauccugggaaauccugagugugaaucuuugucaacagcaaguagcugguccuacauuguggagaccucuucgucagacaacggcacuugcuauccaggugauuuuaucgacuacgaagaacucagggagcagcugagcaguguuuccucuuucgaacgguuugagauuuucccgaagacaagcuccuggcccaaucacgauucaaacaagggggugaccgccgcuuguccucaugcaggagccaaaaguuuuuauaagaaucugaucuggcucgucaaaaagggcaacagcuacccaaaauuaucuaaguccuauauaaaugacaagggcaaagaagugcugguacuuugggggauccaccaccccucaacgagcgcugaucaacagaguuuguaccagaacgccgacgcguacguuuucgugggaacuucucgcuauuccaagaaauuuaagccugagauugcaauccgaccaaaaguccgugaucaggaggguagaaugaauuacuauuggacccugguggaacccggcgacaagauuacauucgaggccacugggaaccuaguggucccuagguacgcuuuugccauggaacggaacgcaggaagcggcaucauaauuucggauaccccaguucaugacugcaauacaaccugucaaacgccgaaaggugcuaucaacacuucucuccccuuccagaauauucacccuaucacaaucgggaagugcccaaaguaugugaaauccaccaagcugcgccuugccacuggacugagaaacguacccucaauucagaguaggggcuuguuuggcgcgauagccggguucaucgagggagguuggacaggcaugguggacgggugguacggauaucaucaccagaaugaacaaggcagcgguuacgcagcugaucucaaauccacccagaacgccauugacgagaucacgaauaaggucaacucugugauagagaaaaugaauacccaguuuacagcuguugggaaggaguucaaccaccuggagaagcggauugaaaauuuaaacaaaaagguggaugacggcuuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaaucggaaacggcuguuuugaguucuaucacaagugcgacaauacauguauggaaaguguuaaaaacgggacuuacgauuauccuaaguacuccgaggaagccaaacugaauagagaggagauugacggagugaaacuugaaagcaccaggaucuaucaaauucuggcuauauacucuacagucgcgucaaguuuggugcucgucgugagccugggugcaaucuccuuuuggaugugcucuaacggcucguuacagugccggauuuguaucuga

SEQ ID NO: 127356 - RNA, 1701 nt, Artificial Sequence; identical to SEQ ID NO: 124685
  derived and/or modified sequence opt3 from hemagglutinin__InfluenzaA__ADK90199

SEQ ID NO: 127357 - RNA, 1701 nt, Artificial Sequence
  derived and/or modified sequence opt3 from hemagglutinin__InfluenzaA__ADK90200
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauugccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacgagaucaccaauaaggugaacucuguuauagagaaaaugaauacgcaguuuaccgccguggguaaggaguucaaccaccuggaaaagcggauugaaaauuuaaacaaaaaggucgaugacggguuccuggauaucuggacauacaaugcagagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagagaggagauugacggggucaaacuugaaagcacuaggaucuaucaaauucuggcgguguacucuaccgucgcaucaaguuuggugcucguugugagccugggagccauauccuuuuggaugugcucuaacgguucguuacagugccggaucuguauuuga

SEQ ID NO: 127358 - RNA, 1701 nt, Artificial Sequence
  derived and/or modified sequence opt3 from hemagglutinin__InfluenzaA__ADK90201
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcagugcgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 127359 - RNA, 1701 nt, Artificial Sequence
  derived and/or modified sequence opt3 from hemagglutinin__InfluenzaA__ADK90202
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaccauugucuacagcaucaaguuggagcuacauuguugagaccuccucuucggacaacggaacuugcuauccgggcgauuuuaucgacuacgaggagcucagggagcagcugucaagcgugaguuccuucgaacggcuggagauuuuucccaagacaucuagcuggccuaaucacgauuccaacaagggugucaccgccgcuuguccacaugcaggggccaaaucauucuauaagaaucucaucugguuagugaaaaagggaaacaguuaccccaaacugagcaagucuuauauaaaugacaagggcaaagaaguacuuguuuuguggggcauccaccacccuuccacgucagcugaucaacagagccuguaccagaacgccgacgcguacguguuugucgggacuucccgcuauucuaagaaauucaagccagagauugcaauccgacccaaagugcgugaucaggagggaagaaugaauuacuauuggacccuaguggaaccuggugacaagauuacauuugaggccacuggcaaccucgucguuccaagguacgcuuucgccauggaacggaacgcaggguccggaaucauaauuagcgauaccccggugcaugacugcaauacaaccugucaaacgcccaacggcgcuaucaauacuucgcugccuuuucagaacauucacccaaucacaaucgguaaaugccccaaguauguaaagucuaccaaacuucgccuggccacuggguugagaaaugugccuuccauucagucaaggggacucuucggcgcgauagccggcuuuaucgaagggggauggacagguauggucgacggcugguacggguaucaucaccagaacgaacaaggaaguggcuacgcagcugaucuuaagagcacccagaaugccauugacgagaucacgaacaaagugaauaguguuauagagaagaugaacacccaguucacagcuguggguaaagaauuuaaucacuuagagaagcggauugaaaaccugaauaagaaagucgaugacggguuccucgauaucuggacuuacaacgccgagcuucugguguugcuagaaaaugagcgcacccuggacuaucaugauucuaacguaaagaaccucuacgagaaaguucgaagccagcugaagaauaacgcaaaagaaaucggcaauggauguuucgaguuuuaucacaagugcgacaacacauguauggaaucagugaagaauggcacuuacgauuauccaaaauacagugaggaagccaagcugaacagagaggagauugacggggucaaacuggaauccaccaggaucuaucaaauuuuggcuauauacagcacaguggcgucuucacucguccuggugguuaguuuaggagcaaucagcuucuggaugugcuccaaugguucucugcagugccggauuuguaucuga

SEQ ID NO: 127360 - RNA, 1701 nt, Artificial Sequence; identical to SEQ ID NO: 124865
  derived and/or modified sequence opt3 from hemagglutinin__InfluenzaA__ADK90203

SEQ ID NO: 127361 - RNA, 1701 nt, Artificial Sequence; identical to SEQ ID NO: 125786
  derived and/or modified sequence opt3 from hemagglutinin__InfluenzaA__ADK90204

SEQ ID NO: 127362 - RNA, 1701 nt, Artificial Sequence
  derived and/or modified sequence opt3 from hemagglutinin__InfluenzaA__ADK94191
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacaggugagaucugcgacagcccacaccagauucuagauggcaaaaauuguacccucaucgacgcucugcuuggggauccgcagugcgacggauuucaaaacaagaaaugggaucuguucgucgaaagauccaaggccuauucuaauuguuaccccuaugacgugccugauuacgcaucguugaggucacucguugccagcaguggcacucuggaguuuaacaaugaauccuucaacuggacaggugugacccagaaugggacgucuagcgcuugcauacggcgcuccaagaacucauuuuucagucgacugaauuggcucacucauuuaaacuuuaaauauccagcacugaaugucaccaugcccaacaacgagcaguucgacaagcuguacaucuggggagugcaccauccuggcacagauaaagaccagauuuuucuuuaugcccaagcuagcggccguaucacuguaucuaccaagagaucccagcagacaguuauuccaaauaucgggucaaggccccgggugcgcaacauaccuagcagagucaguauuuacuggaccaucgugaaaccaggagauauucugcuaaucaauucuacggguaaccucaucgccccgaggggcuacuucaagauucgguccgggaaaagcucgauaaugcgcucugacgcgcccaucggaaaauguaauuccgagugcauuacuccuaacggcucaaucccaaaugacaagcccuuucagaacgugaaucgaauaacauauggugcauguccuagauacgucaaacaaaacacccugaaguuggccacugggaugaggaauguuccagaaaaacagacacggggaauuuucggcgcuaucgccggcuuuaucgagaacgggugggaaggaaugguggaugguugguauggcuuccgucaccagaauagugaggggcgcggacaagcagcugaccuuaagagcacccaggccgcgauugaucagaucaacggcaaauugaauagacucauugguaagacgaacgagaaguuccaccagauagaaaaagaguuuuccgaaguagaggggaggauccaagaccuggaaaaguacguggaggauaccaaaauugacuuauggucuuauaacgccgagcugcucgucgcacuugaaaaucagcauacaaucgaucugacugacagcgagaugaacaaguuguucgaaaagaccaagaagcagcuacgggagaaugcugaagauaugggcaacggaugcuuuaaaaucuaccacaagugugacaaugccugcauuggcucaauacgaaacgggacauaugaucaugacguguaccgcgacgaggcucugaauaacagauuccagaucaaaggaguugagcucaagagugguuacaaagauuggauucuguggaucuccuuugccauuagcugcuuccuucuguguguggcauugcucggcuuuaucaugugggccugccaaaaggggaauauaagguguaacaucugcauuuga

SEQ ID NO: 127363 - RNA, 1701 nt, Artificial Sequence
  derived and/or modified sequence opt3 from hemagglutinin__InfluenzaA__ADK94202
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacaauucauuuuucagucgacugaacuggcucacucauuuaaaguuuaaguauccagcacugaauguuaccaugcccaacaacgagcaguucgacaaacuuuacaucuggggagugcaccauccuggcacagauaaugaccagaucuuuuuguaugcccaagcuagcggccguauuacugucucuaccaagagaucccagcagacagugauaccaaacauugggucaaggccccggguacgcaauaucccuagcagaauuaguaucuacuggaccaucguuaaaccaggagauauucugcuaauaaacucuacggguaaucucaucgccccgaggggcuacuucaagauucgguccgggaaaagcucgaucaugcgcucugacgcgcccauaggaaaguguaacuccgaaugcauuacuccuaauggcucaaucccaaacgacaagcccuuucagaaugugaaccgaaucacauauggugcauguccuagauacgucaaacaaaauacccugaagcuggccacugggaugaggaacgugccagagaaacagacacggggaauuuucggcgcuaucgccggcuuuauugaaaaugggugggagggaaugguggaugguugguauggcuuccgucaccagaacagugaggggcgcggacaagcagcugaccuuaagagcacccaggccgcgauagaucagaucaauggcaaauugaacagacucauugguaagacgaacgaaaaauuccaccagaucgagaaggaauuuuccgaggucgaagggaggauccaagaccuggagaaguacguugaggauaccaaaauugacuuauggucuuauaaugccgaacugcucguggcacuugagaaccagcauacaauagaucugacugacagcgaaaugaauaaguuguucgagaaaaccaagaaacagcuacgggaaaacgcugaggauaugggcaauggaugcuuuaagaucuaccacaagugugacaacgccugcauuggcucaauccgaaaugggacauaugaucaugacguauaccgcgacgaggcucugaacaauagauuccagauuaaaggaguggaacucaagagugguuacaaagauuggauccuguggauauccuuugccaucagcugcuuccuucugugugucgcauugcucggcuuuauuaugugggccugccaaaaggggaacaucagguguaauauuugcaucuga

SEQ ID NO: 127364 - RNA, 1701 nt, Artificial Sequence; identical to SEQ ID NO: 124450
  derived and/or modified sequence opt3 from hemagglutinin__InfluenzaA__ADK94213

SEQ ID NO: 127365 - RNA, 1701 nt, Artificial Sequence; identical to SEQ ID NO: 125629
  derived and/or modified sequence opt3 from hemagglutinin__InfluenzaA__ADK94224

SEQ ID NO: 127366 - RNA, 1701 nt, Artificial Sequence
  derived and/or modified sequence opt3 from hemagglutinin__InfluenzaA__ADK94257
auggagaccaucauugcccugagcuacauacucugccuuguguucgcucagaagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcgacagcccacaccagauccuagauggcaagaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaagaacucauuuuucagucgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaagcuagcggccguauuacugugucuaccaaaagaucccagcagacaguaaucccaaauauagggucaaggccccggguucgcaacauuccuagcagaaucaguauuuacuggaccaucgugaagccaggagauauccugcuaauuaauucuacggguaaccucauagccccgaggggcuacuucaaaauccgguccggaaagagcucgauuaugcgcucugacgcgcccaucgggaaguguaauuccgaaugcauaacuccuaacggcucaauuccaaaugacaaacccuuucagaacgucaaucgaaucacauauggugcauguccuagauacgugaagcaaaguacccugaaacuugccacugggaugaggaacgugccagagaagcagacacggggaaucuucggcgcuauugccggcuuuaucgaaaaugggugggagggaauggucgaugguugguauggcuuccgucaccagaacagcgaggggcgcggacaagcagcugaccugaaauccacccaggccgcgauugaucagauaaauggcaaguugaacagacucaucgguaaaacgaaugaaaaguuccaccagauugagaaggaauuuucugagguugaagggaggauccaagaccuggagaaauacguggaggauaccaagaucgacuuauggagcuauaacgccgaacugcucguagcacuugagaaccagcauacaauugaucugacugacucagaaaugaauaaauuguucgagaagaccaaaaagcagcuacgggaaaacgcugaggauaugggcaauggaugcuuuaagauauaccacaaaugugacaacgccugcaucggcaguauucgaaaugggacauaugaucaugacguguaccgcgacgaggcucugaacaauagauuccagaucaagggagucgaacucaaauccgguuacaaggauuggauucuguggaucagcuuugccauaucuugcuuccuucuguguguggcauugcucggcuuuaucaugugggccugccaaaaagggaacauuagguguaauaucugcauuuga

SEQ ID NO: 127367 - RNA, 1701 nt, Artificial Sequence
  derived and/or modified sequence opt3 from hemagglutinin__InfluenzaA__ADK94268
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgucaaucgaaucacauauggugcauguccuagauacgugaaacaaaguacccugaaacuugccacugggaugaggaacgugccagaaaagcagacacggggaaucuucggcgcuauugccggcuuuaucgagaaugggugggaaggaauggucgaugguugguauggcuuccgucaccagaacagcgaggggcgcggacaagcagcugaccugaaguccacccaggccgcgauugaucagauaaauggcaaauugaacagacucaucgguaagacgaaugagaaguuccaccagauugaaaaagaguuuucugaaguugaggggaggauccaagaccuggaaaaguacguggaggauaccaaaaucgacuuauggagcuauaacgccgagcugcucguagcacuugaaaaccagcauacaauugaucugacugacucagagaugaauaaguuguucgaaaagaccaagaagcagcuacgggagaacgcugaagauaugggcaauggaugcuuuaaaauauaccacaagugugacaacgccugcaucggcaguauucgaaaugggacauaugaucaugacguguaccgcgacgaggcucugaacaauagauuccagaucaaaggagucgagcucaaguccgguuacaaagauuggauucuguggaucagcuuugccauaucuugcuuccuucuguguguggcauugcucggcuuuaucaugugggccugccaaaaggggaacauuagguguaauaucugcauuuga

SEQ ID NO: 127368 - RNA, 1701 nt, Artificial Sequence
  derived and/or modified sequence opt3 from hemagglutinin__InfluenzaA__ADK94279
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguauccagcacugaacgugaccaugcccaacaaugagcaguucgauaaacuuuacauuuggggaguccaccauccuggcacagacaacgaucagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagacauccugcuaauuaauucuacggguaaccucauagccccgaggggcuacuucaagauccgguccgggaaaagcucgauuaugcgcucugaugcgcccaucggaaaguguaauuccgaaugcauaacuccuaacggcucaauuccaaaugacaagcccuuucagaacgucaaucgaaucacauauggugcauguccuagauacgugaaacaaaacacccugaagcuggccacugggaugaggaaugugccagagaaacagacacggggaaucuucggcgcuauugccggcuuuaucgaaaacgggugggagggaauggucgacgguugguauggcuuccgucaccagaauagugaggggcgcggacaagcagcugaucuuaagagcacccaggccgcgauugaccagauaaacggcaaauugaacagacucaucgguaagacgaaugaaaaauuccaccagauugagaaggaauuuuccgagguugaagggaggauccaagaucuggagaaguacguggaggacaccaaaaucgauuuauggucuuauaacgccgaacugcucguagcacuugagaaucagcauacaauugaccugacugauagcgaaaugaacaaguuguucgagaaaaccaagaaacagcuacgggaaaaugcugaggacaugggcaacggaugcuuuaagauauaccacaagugugauaaugccugcaucggcucaauucgaaacgggacauaugaccaugauguguaccgcgacgaggcucugaauaacagauuccagaucaaaggagucgaacucaagagugguuacaaagacuggauucuguggaucuccuuugccauaagcugcuuccuucuguguguggcauugcucggcuuuaucaugugggccugccaaaaggggaauauuagguguaacaucugcauuuga

SEQ ID NO: 127369 - RNA, 1701 nt, Artificial Sequence; identical to SEQ ID NO: 125629
  derived and/or modified sequence opt3 from hemagglutinin__InfluenzaA__ADK94290

SEQ ID NO: 127370 - RNA, 1701 nt, Artificial Sequence; identical to SEQ ID NO: 125629
  derived and/or modified sequence opt3 from hemagglutinin__InfluenzaA__ADK94301

SEQ ID NO: 127371 - RNA, 1701 nt, Artificial Sequence
  derived and/or modified sequence opt3 from hemagglutinin__InfluenzaA__ADK94323
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggauucgcaacaucccuagcagaauuaguaucuacuggaccaucguuaaaccaggagauauucugcuaauaaauucuacggguaaccucaucgccccgaggggcuacuucaagauucgguccggaaagagcucgaucaugcgcucugacgcgcccauagggaaauguaauuccgagugcauuacuccuaacggcucaaucccaaaugacaagcccuuucagaacgugaaucgaaucacauauggugcauguccuagauacgucaaacaaaacacccugaaacuugccacugggaugaggaaugugccagaaaaacagacacggggaauuuucggcgcuaucgccggcuuuauugagaacgggugggaaggaaugguggaugguugguauggcuuccgucaccagaauagugaggggcgcggacaagcagcugaccuuaagagcacccaggccgcgauagaucagaucaacggcaaauugaauagacucauugguaagacgaacgagaaguuccaccagaucgaaaaagaguuuuccgaagucgaggggaggauccaagaccuggaaaaguacguugaggauaccaaaauugacuuauggucuuauaacgccgagcugcucguggcacuugaaaaucagcauacaauagaucugacugacagcgagaugaacaaguuguucgaaaagaccaagaagcagcuacgggagaaugcugaagauaugggcaacggaugcuuuaaaaucuaccacaagugugacaaugccugcauuggcucaauccgaaacgggacauaugaucaugacguauaccgcgacgaggcucugaauaacagauuccagauuaaaggaguggagcucaagagugguuacaaagauuggauccuguggauauccuuugccaucagcugcuuccuucugugugucgcauugcucggcuuuauuaugugggccugccaaaaggggaauaucagguguaacauuugcaucuga

SEQ ID NO: 127372 - RNA, 1701 nt, Artificial Sequence; identical to SEQ ID NO: 127362
  derived and/or modified sequence opt3 from hemagglutinin__InfluenzaA__ADK94441

SEQ ID NO: 127373 - RNA, 1701 nt, Artificial Sequence
  derived and/or modified sequence opt3 from hemagglutinin__InfluenzaA__ADK94476
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucacuuaaacuuuaaauacccagcacugaaugugaccaugcccaacaacgagcaguucgacaagcuguauauuuggggagcccaucacccuggcacagauaaagaccagaucuuuuuguacgcucaagccagcggccguauuacugucucuaccaagagaucccagcagacagugaucccaaauauagggucaaggccccggguacgcaacauuccuagcagaaucaguauuuauuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauacggugccuguccuagauaugucaaacaaaacacccugaaacuugcuacugggaugaggaaugugccagaaaaacagacacggggaaucuucggcgccauugcaggcuuuaucgagaacgggugggaaggaaugguggaugguugguacggcuuccgucaccagaauagugaggggcgcggacaagcugccgaccuuaagagcacccaggcggccauugaucagauaaacggcaaauugaauagacucaucgguaagacgaacgagaaguuccaucagauugaaaaagaguuuuccgaagucgaggggaggauccaagaccuggaaaaguauguugaggauaccaaaaucgacuuauggucuuacaacgcagagcugcucguggcucuugaaaaucagcacacaauugaucugacugacagcgagaugaacaaguuguucgaaaagaccaagaagcagcuacgggagaaugccgaagauaugggcaacggaugcuuuaaaauauaucauaagugugacaaugcuugcaucggcucaauucgaaacgggacauacgaucacgacguauaucgcgacgaggcccugaauaacagauuccagaucaaaggaguggagcucaagagugguuacaaagauuggauucuguggaucuccuuugcaauaagcugcuuccuucugugugucgccuugcucggcuuuaucaugugggcuugccaaaaggggaauauuagguguaacaucugcauuuga

SEQ ID NO: 127374 - RNA, 1701 nt, Artificial Sequence; identical to SEQ ID NO: 125629
  derived and/or modified sequence opt3 from hemagglutinin__InfluenzaA__ADK94487

SEQ ID NO: 127375 - RNA, 1701 nt, Artificial Sequence
  derived and/or modified sequence opt3 from hemagglutinin__InfluenzaA__ADK94498
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacaggugagaucugcgacagcccacaccagauucuagauggcaaaaauuguacccucaucgacgcucugcuuggggauccgcagugcgacggauuucaaaacaagaaaugggaucuguucgucgaaagauccaaggccuauucuaauuguuaccccuaugacgugccugauuacgcaucguugaggucacucguugccagcaguggcacucuggaguuuaacaaugaauccuucaacuggacaggugugacccagaaugggacgucuagcgcuugcauacggcgcuccaagaacucauuuuucagucgacugaauuggcucacucauuuaaacuuuaaauauccagcacugaaugucaccaugcccaacaacgagcaguucgacaagcuguacaucuggggagugcaccauccuggcacagauaaagaccagauuuuucuuuaugcccaagcuagcggccguaucacuguaucuaccaagagaucccagcagacaguuauuccaaauaucgggucaaggccccgggugcgcaacauaccuagcagaauuaguaucuacuggaccauugucaaaccaggagauauccugcuaaucaauucuacggguaaccucauugccccgaggggcuacuucaagauacgguccgggaaaagcucgaucaugcgcucugacgcgcccauuggaaaauguaauuccgagugcaucacuccuaacggcucaauaccaaaugacaagcccuuucagaacgugaaucgaauuacauauggugcauguccuagauacgugaaacaaaacacccugaaguuggccacugggaugaggaaugucccagaaaaacagacacggggaaucuucggcgcuaucgccggcuuuauugagaacgggugggaaggaaugguugaugguugguauggcuuccgucaccagaauagugaggggcgcggacaagcagcugaccuuaagagcacccaggccgcgaucgaucagauuaacggcaaauugaauagacucauagguaagacgaacgagaaguuccaccagaucgaaaaagaguuuuccgaaguggaggggaggauucaagaccuggaaaaguacguagaggauaccaaaaucgacuuauggucuuauaacgccgagcugcucguggcacuugaaaaucagcauacaaucgaucugacugacagcgagaugaacaaguuguucgaaaagaccaagaagcagcuacgggagaaugcugaagauaugggcaacggaugcuuuaaaauuuaccacaagugugacaaugccugcauaggcucaauccgaaacgggacauauaaucaugaugucuaccgcgacgaggcucugaacaauagauuccagauuaaaggaguggagcucaagagugguuacaaagacuggauccuguggauuuccuuugccaucagcugcuuccuucuguguguugcauugcucggcuuuauaaugugggccugccaaaaggggaacaucagguguaauauuugcaucuga

SEQ ID NO: 127376 - RNA, 1701 nt, Artificial Sequence
  derived and/or modified sequence opt3 from hemagglutinin__InfluenzaA__ADK94509
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacaucaaacaaaacacccugaaacuugcuacugggaugaggaaugucccagaaaaacagacacggggaauuuucggcgccaucgcaggcuuuauugagaacgggugggaaggaaugguggaugguugguauggcuuccgucaccagaauagugaggggcgcggacaagcugccgaccuuaagagcacccaggcggccauagaucagaucaacggcaaauugaauagacucauugguaagacgaacgagaaguuccaccagaucgaaaaagaguuuuccgaaguggaggggaggauccaagaccuggaaaaguacgucgaggauaccaaaauugacuuauggucuuauaacgcagagcugcucguugcucuugaaaaucagcauacaauagaucugacugacagcgagaugaacaaguuguucgaaaagaccaagaagcagcuacgggagaaugccgaagauaugggcaacggaugcuuuaaaaucuaccacaagugugacaaugcuugcauuggcucaauccgaaacgggacauaugaucaugacguguaccgcgacgaggcccugaauaacagauuccagauuaaaggaguagagcucaagagugguuacaaagauuggauccuguggauauccuuugcaaucagcugcuuccuucuguguguggccuugcucggcuuuauuaugugggcuugccaaaaggggaauaucagguguaacauuugcaucuga

SEQ ID NO: 127377 - RNA, 1701 nt, Artificial Sequence
  derived and/or modified sequence opt3 from hemagglutinin__InfluenzaA__ADK94520
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacaauucauuuuucagucgacugaacuggcucacucauuuacguuuuaaguauccagcacugaauguuaccaugcccaacaacgagcaguucgacaaguuguacaucuggggagugcaccauccuggcacagauaaugaccagauuuuucuuuaugcccaagcuagcggcagaaucacugucucuaccaaaaggucccagcagacagugauaccaaacauugggucacggccccgcguaagaaauaucccuagcaggauuaguaucuacuggaccaucguuaagccaggagauauucugcuaauaaacucuacggguaaucucaucgccccgcggggcuacuucaaaauucgcuccggaaagagcucgaucaugcgaucugacgcgcccauagggaaauguaacuccgaaugcauuacuccuaauggcucaaucccaaacgacaagcccuuucagaaugugaacagaaucacauauggugcauguccuagguacgucaagcaaaauacccugaaacuugccacugggaugcggaacgugccagagaagcagacacguggaauuuucggcgcuaucgccggcuuuauugaaaaugggugggagggaaugguggaugguugguauggcuuccgccaccagaacagugaggggagaggacaagcagcugaccugaaaagcacccaggccgcgauagaucagaucaauggcaaguugaacaggcucauugguaaaacgaacgaaaaguuccaccagaucgagaaagaauuuuccgaggucgaagggcggauccaagaccuggagaaguacguugaggauaccaagauugacuuauggucuuauaaugccgaacugcucguggcacuugagaaccagcauacaauagaucugacugacagcgaaaugaauaaauuguucgagaagaccaaaaagcagcuacgagaaaacgcugaggauaugggcaauggaugcuuuaaaaucuaccacaagugugacaacgccugcauuggcucaauccgcaaugggacauaugaucaugacguauacagagacgaggcucugaacaauagguuccagauuaagggaguggaacucaaaagugguuacaaggauuggauccuguggauauccuuugccaucagcugcuuccuucugugugucgcauugcucggcuuuauuaugugggccugccaaaaagggaacaucaaguguaauauuugcaucuga

SEQ ID NO: 127378 - RNA, 1701 nt, Artificial Sequence; identical to SEQ ID NO: 125629
  derived and/or modified sequence opt3 from hemagglutinin__InfluenzaA__ADK94531

SEQ ID NO: 127379 - RNA, 1701 nt, Artificial Sequence; identical to SEQ ID NO: 124450
  derived and/or modified sequence opt3 from hemagglutinin__InfluenzaA__ADK94542

SEQ ID NO: 127380 - RNA, 1701 nt, Artificial Sequence
  derived and/or modified sequence opt3 from hemagglutinin__InfluenzaA__ADK94553
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgucaaucgaaucacauauggugcauguccuagauacgugaaacaaaguacccugaaacuugccacugggaugaggaacgugccagaaaagcagacacggggaaucuucggcgcuauugccggcuuuaucgagaaugggugggaaggaauggucgaugguugguauggcuuccgucaccagaacagcgaggggcgcggacaagcagcugaccugaaguccacccaggccgcgauugaucagauaaauggcaaauugaacagacucaucgguaagacgaaugagaaguuccaccagauugaaaaagaguuuucugaaguugaggggaggauccaagaccuggaaaaguacguggaggauaccaaaaucgacuuauggagcuauaacgccgagcugcucguagcacuugaaaaccagcauacaauugaucugacugacucagagaugaauaaguuguucgaaaagaccaagaagcagcuacgggagaacgcugaagauaugggcaauggaugcuuuaaaauauaccacaaguguaacaaugccugcaucggcaguauucgaaacgggacauaugaccaugauguguaccgcgacgaggcucugaauaacagauuccagaucaaaggagucgagcucaaguccgguuacaaagacuggauucuguggaucagcuuugccauaucuugcuuccuucuguguguggcauugcucggcuuuaucaugugggccugccaaaaggggaauauuagguguaacaucugcauuuga

SEQ ID NO: 127381 - RNA, 1701 nt, Artificial Sequence; identical to SEQ ID NO: 125629
  derived and/or modified sequence opt3 from hemagglutinin__InfluenzaA__ADK94564

SEQ ID NO: 127382 - RNA, 1701 nt, Artificial Sequence
  derived and/or modified sequence opt3 from hemagglutinin__InfluenzaA__ADK98501
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgagacuaccgggaaccuagucguuccuagguacgccuuugcuauggaacggaacgccggaagcggcaucauaauuucggacacaccagugcaugauugcaauaccacgugucaaacuccgaaaggugcaaucaacacaucucuccccuuccagaauauucacccuaucaccaucgggaagugcccaaaguauguaaaauccacuaagcugcgccuugcuacaggacugagaaacgugcccucaauucagaguaggggcuuguuuggcgccauagcgggguucaucgagggagguuggaccggcauggucgacgggugguacggauaucaucaccagaaugaacaaggcagcgguuacgccgcagaccucaaauccacgcagaacgcuauugaugagaucaccaauaaggugaacucuguuauagagaaaaugaauacacaguuuacugccguggggaaggaguucaaccaccuggagaagcggauugaaaauuuaaacaaaaaggucgacgauggcuuccuggacaucuggaccuacaaugcugagcuccuugugcuguuggaaaacgagcgcacacuagauuaucaugacagcaauguaaagaaccuguacgagaagguucgaucacagcucaaaaacaaugccaaggaaaucggaaacggcuguuuugaguucuaucacaagugcgauaauacuuguauggaaagugugaaaaacgggaccuacgacuauccuaaguacuccgaggaagcaaaacugaauagagaggagauugauggagucaaacuugaaagcacaaggaucuaucaaauucuggccauauacucuaccguggcuucaaguuugguccucgugguuagccugggugcgaucuccuuuuggaugugcucuaacggcucguuacagugccggauuuguaucuga

SEQ ID NO: 127383 - RNA, 1701 nt, Artificial Sequence
  derived and/or modified sequence opt3 from hemagglutinin__InfluenzaA__ADK98503
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacguggacgccuacgucuucguggggaccagucgcuauucuaagaaauuuaagccagagauugcgauccgacccaaagugcgugaucaggagggaagaaugaauuacuauuggacucuggucgaaccuggugacaagauuacauucgaggcaacuggcaaccuaguugugccaagguacgccuuugcuauggaacggaacgccggguccggaaucauaauuagcgauaccccgguacaugacugcaauacaaccugucaaacgcccaaaggcgcaaucaacacuucgcucccuuuccagaauauucacccaaucacaaucgguaagugccccaaguaugugaaaucuaccaagcugcgccuugcuacugggcugagaaacgucccuuccauucagucaaggggauuguuuggcgccauagcgggcuucaucgaagggggauggacagguaugguggacggcugguacggguaucaucaccagaaugaacaaggaaguggcuacgccgcagaucucaaaagcacccagaacgcuauugacgagaucacgaauaagguuaacuccgugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauucuaauguuaaaaaccuguacgagaaggugcgaagccagcucaaaaacaaugccaaggaaaucggcaacggauguuuugaguucuaucacaagugcgacaauacauguauggaaucagucaaaaacggcacuuacgauuauccaaaguacagugaggaagcaaaacugaauagagaggagauugacggggugaaacuugaauccaccaggaucuaucaaauucuggccauauacagcacagucgcuucuucauuggugcucguugugagucugggagcgaucagcuuuuggaugugcuccaacgguucuuuacagugccggauuuguaucuga

SEQ ID NO: 127384 - RNA, 1701 nt, Artificial Sequence; identical to SEQ ID NO: 127367
  derived and/or modified sequence opt3 from hemagglutinin__InfluenzaA__ADK98623

SEQ ID NO: 127385 - RNA, 1701 nt, Artificial Sequence; identical to SEQ ID NO: 124450
  derived and/or modified sequence opt3 from hemagglutinin__InfluenzaA__ADK98634

SEQ ID NO: 127386 - RNA, 1701 nt, Artificial Sequence; identical to SEQ ID NO: 124450
  derived and/or modified sequence opt3 from hemagglutinin__InfluenzaA__ADK98645

SEQ ID NO: 127387 - RNA, 1701 nt, Artificial Sequence; identical to SEQ ID NO: 127313
  derived and/or modified sequence opt3 from hemagglutinin__InfluenzaA__ADK98656

SEQ ID NO: 127388 - RNA, 1701 nt, Artificial Sequence; identical to SEQ ID NO: 127380
  derived and/or modified sequence opt3 from hemagglutinin__InfluenzaA__ADK98667

SEQ ID NO: 127389 - RNA, 1701 nt, Artificial Sequence
  derived and/or modified sequence opt3 from hemagglutinin__InfluenzaA__ADK98678
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacucagaauggcucaauuccuaacgacaagccauuucaaaaugucaaccgaaucacauauggugcaugucccagauacgugaaacagaauacccugaagcuggccacugggaugaggaacgugccugagaaacagacacggggaaucuucggcgcuauugccggcuuuaucgaaaaugggugggagggaauggucgaugguugguauggcuuccgucaccaaaacagugaggggcgcggacaggcagcugaccuuaagagcacccaggccgcgauugaucagauaaauggcaaauugaacagacucaucgguaagacgaacgaaaaauuccaccaaauugagaaggaauuuuccgagguugaagggaggauccaggaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccaaaucaaaggagucgaacucaagagugguuacaaagauuggauucuguggaucuccuuugccauaagcugcuuccuucuguguguggcauugcucggcuuuaucaugugggccugccagaaggggaacauuagguguaauaucugcauuuga

SEQ ID NO: 127390 - RNA, 1701 nt, Artificial Sequence; identical to SEQ ID NO: 124450
  derived and/or modified sequence opt3 from hemagglutinin__InfluenzaA__ADK98689

SEQ ID NO: 127391 - RNA, 1701 nt, Artificial Sequence; identical to SEQ ID NO: 124450
  derived and/or modified sequence opt3 from hemagglutinin__InfluenzaA__ADK98700

SEQ ID NO: 127392 - RNA, 1701 nt, Artificial Sequence; identical to SEQ ID NO: 124450
  derived and/or modified sequence opt3 from hemagglutinin__InfluenzaA__ADK98711

SEQ ID NO: 127393 - RNA, 1701 nt, Artificial Sequence
  derived and/or modified sequence opt3 from hemagglutinin__InfluenzaA__ADK98722
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaaggggucccagcagacaguaaucccaaacauaggaucaagacccaggguucggaauauuccuagccgcaucaguauuuacuggaccaucgugaaaccaggugauauccugcuaauuaacucuacgggcaaucucauagccccgagaggguacuucaagaucagguccggaaaaagcucgauuaugcggucugacgcgcccaucggcaaguguaacuccgaaugcauaacuccuaaugguucaauuccaaacgacaagcccuuucagaaugucaaccgcaucacauauggggcauguccucgauacgugaaacaaaauacccugaagcuggccacuggaaugagaaacgugccagagaaacagacaaggggcaucuucggcgcuauugccggguuuaucgaaaauggaugggaggguauggucgauggcugguauggguuccggcaccagaacagugagggacguggccaagcagcugaccuuaagagcacccaggccgcgauugaucagauaaaugguaaauugaaccgccucaucgggaagacgaacgaaaaauuccaccagauugagaaggaauuuuccgagguugaaggcagaauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuaagggaaaacgcugaggauaugggaaauggcugcuuuaagauauaccacaagugugacaacgccugcaucgggucaauucggaauggaacauaugaucaugacguguaccgagacgaggcucugaacaaucgcuuccagaucaaaggugucgaacucaagaguggcuacaaagauuggauucuguggaucuccuuugccauaagcugcuuccuucuguguguggcauugcucggguuuaucaugugggccugccaaaagggaaacauuagauguaauaucugcauuuga

SEQ ID NO: 127394 - RNA, 1701 nt, Artificial Sequence; identical to SEQ ID NO: 127367
  derived and/or modified sequence opt3 from hemagglutinin__InfluenzaA__ADK98733

SEQ ID NO: 127395 - RNA, 1701 nt, Artificial Sequence; identical to SEQ ID NO: 124450
  derived and/or modified sequence opt3 from hemagglutinin__InfluenzaA__ADK98744

SEQ ID NO: 127396 - RNA, 1701 nt, Artificial Sequence; identical to SEQ ID NO: 124450
  derived and/or modified sequence opt3 from hemagglutinin__InfluenzaA__ADK98777

SEQ ID NO: 127397 - RNA, 1701 nt, Artificial Sequence; identical to SEQ ID NO: 124450
  derived and/or modified sequence opt3 from hemagglutinin__InfluenzaA__ADK98788

SEQ ID NO: 127398 - RNA, 1701 nt, Artificial Sequence; identical to SEQ ID NO: 125629
  derived and/or modified sequence opt3 from hemagglutinin__InfluenzaA__ADK98799

SEQ ID NO: 127399 - RNA, 1701 nt, Artificial Sequence
  derived and/or modified sequence opt3 from hemagglutinin__InfluenzaA__ADK98810
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaccuuuuuguaugcccaagcuagcggccguaucacugugucuacaaagagaucccagcagaccguaauuccaaacaucgggucaaggccccggguucgcaauauaccuagcagaauuaguaucuacuggacgauugugaaaccaggagauauccugcuaaucaacucuacugguaaucucauugccccgaggggcuacuucaagauacgguccgggaaaagcucgaucaugcgcucugacgcgcccauuggaaaguguaacuccgaaugcaucacaccuaauggcucaauaccaaacgacaagcccuuucagaaugucaaccgaauuaccuauggugcauguccuagauacgugaaacaaaauacucugaagcuggccacagggaugaggaacgugccagagaaacagacccggggaaucuucggcgcuaucgccggcuuuauugaaaaugggugggagggaauggucgaugguugguauggcuuccgucaccagaacagugaggggcgcggacaagcagcugaccuuaagagcacgcaggccgcgaucgaucagauuaauggcaaauugaacagacucauagguaagaccaacgaaaaauuccaccagaucgagaaggaauuuuccgagguugaagggaggauucaagaccuggagaaguacguggaggauacaaaaaucgacuuauggucuuauaaugccgaacugcucguagcacuugagaaccagcauacuaucgaucugaccgacagcgaaaugaauaaguuguucgagaaaacaaagaaacagcuacgggaaaacgcugaggauaugggcaauggaugcuuuaagauuuaccacaagugugacaacgccugcauaggcucaauccgaaaugggacuuaugaucauaacguguaccgcgacgaggcucugaauaacagauuccagauuaaagaagucgagcucaagaguggauacaaagacuggauccuguggauuuccuuugccaucagcugcuuccuucuguguguggcauugcucgguuuuauaaugugggccugccaaaagggcaauaucagguguaacauuugcaucuga

SEQ ID NO: 127400 - RNA, 1701 nt, Artificial Sequence
  derived and/or modified sequence opt3 from hemagglutinin__InfluenzaA__ADK98821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauugaucugacugacagcgagaugaacaaguuguucgaaaagacccggaagcagcuacgagagaaugccgaagauaugggcaacggaugcuuuaagauauaccacaaaugugacaaugcuugcaucggcucaauucgcaacgggacauaugaucaugacguauacagagacgaggcccugaauaacagguuccagaucaagggaguggagcucaaaagugguuacaaggauuggauucuguggaucuccuuugcaauaagcugcuuccuucugugugucgccuugcucggcuuuaucaugugggcuugccaaaaagggaauauucgguguaacaucugcauuuga

SEQ ID NO: 127401 - RNA, 1701 nt, Artificial Sequence; identical to SEQ ID NO: 124450
  derived and/or modified sequence opt3 from hemagglutinin__InfluenzaA__ADK98832

SEQ ID NO: 127402 - RNA, 1701 nt, Artificial Sequence; identical to SEQ ID NO: 127380
  derived and/or modified sequence opt3 from hemagglutinin__InfluenzaA__ADK98843

SEQ ID NO: 127403 - RNA, 1701 nt, Artificial Sequence
  derived and/or modified sequence opt3 from hemagglutinin__InfluenzaA__ADK98854
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaauuuaaguauccagcucugaaugugacaaugcccaacaacgagcaguucgacaaacuuuacauuuggggaguccaccauccuggcacugauaaugaccagaucuuuuuguaugcacaagccagcggccguauuaccgugucuacaaagagaucccagcagaccguaaucccaaacauagggucaaggccccggguucgcaauauuccuagcagaaucaguauuuacuggacgaucgugaaaccaggagauauccugcuaauuaacucuacugguaaucucauagcuccgaggggcuacuucaagauccgguccgggaaaagcucgauuaugcgcucugacgcccccaucggaaaguguaacuccgaaugcauaacaccuaauggcucaauuccaaacgacaagcccuuucagaaugucaaccgaaucaccuauggugcguguccuagauacgugaaacaaaauacucugaagcuggcaacagggaugaggaacgugccagagaaacagacccggggaaucuucggcgccauugcuggcuuuaucgaaaaugggugggagggaauggucgaugguugguauggcuuccgucaccagaacagugaggggcgcggacaagccgcagaccuuaagagcacgcaggcugccauugaucagauaaauggcaaauugaacagacucaucgguaagaccaacgaaaaauuccaccagauugagaaggaauuuuccgagguugaagggaggauccaagaccuggagaaguacguggaggauacaaaaaucgacuuauggucuuauaaugcggaacugcucguagcccuugagaaccagcauacuauugaucugaccgacagcgaaaugaauaaguuguucgagaaaacaaagaaacagcuacgggaaaacgcagaggauaugggcaauggaugcuuuaagauauaccacaagugugacaacgcuugcaucggcucaauucgaaaugggacuuaugaucaugacguguaccgcgacgaggcccugaacaauagauuccagaucaaaggagucgaacucaagcccgguuacaaagauuggauucuguggaucaguuuugcuauauccugcuuccuucuguguguggccuugcucggcuuuaucaugugggcaugccaaaaggggaacauuagguguaauaucugcauuuga

SEQ ID NO: 127404 - RNA, 1701 nt, Artificial Sequence
  derived and/or modified sequence opt3 from hemagglutinin__InfluenzaA__ADK98865
augaagaccaucauugcccugagcuacauacucugccuuguguucgcucagaaacugcccggcuccgacaacucuacagcaacuuuguguuuagggcaccaugccgucccuaauggaacgaucguuaagaccauuacaaacgaucaaaucgaggugacuaaugcgaccgaacugguacagucaaguagcacaggugagauuugcgacuccccacaccagauccuagauggcgaaaacuguacccucauagacgcucugcuuggggauccgcagugcgacgauuuucaaaauaaaaagugggaccuguucguggagagaucuaaagccuauucgaacuguuaccccuaugaugucccugacuacgcaucauugaggagccucguggccaguuccggaacucuggaauuuaauaacgagucuuucaauuggacaggcguuacccagaacgguacgagcuccgcuugcauccggcgcucaaguaauagcuuuuucucucgacugaacuggcucacucauuuacguuuuaaguauccagcacugaaugugaccaugcccaacaaugagcaguucgauaaacuuuacauuuggggaguccaccauccugggacagacaacgaucagaucuuuuuguaugcccaggcuuccggcagaauuacugugucaaccaagaggagccaacagacaguaaucccaaacauaggcagucggccccgcguuagaaauauuccuucuaggaucuccauuuacuggaccaucgugaagccaggggacauccugcuaauuaacagcacgggaaaucucauagccccgcgggguuacuucaaaauccgcucgggcaagucuuccauuaugcgaucagacgcgcccaucgggaaauguaacagugaaugcauaacuccuaauggaagcauuccaaacgauaagcccuuucagaaugucaacagaaucacauauggcgcauguccuagguacgugaagcaaaauacccugaaacuugccacugguaugcggaacgugccagagaagcagacacgugggaucuucggagcuauugccggcuuuaucgaaaauggcugggaggggauggucgacggaugguaugguuuccgccaccagaacuccgagggcagagggcaagcagcugaucugaaaucuacccaggccgcgauugaccagauaaauggaaaguugaacaggcucaucggcaaaacgaaugaaaaguuccaccagauugagaaagaauuuagcgagguugaaggucggauccaagaucuggagaaguacguggaggacaccaagaucgauuuauggucauauaacgccgaacugcucguagcacuugagaaccagcauacaauugaccugacugauagugaaaugaauaaauuguucgagaagaccaaaaagcagcuacgagaaaacgcugaggacauggggaauggcugcuuuaaaauauaccacaagugugauaacgccugcaucggauccauucgcaauggcacauaugaccaugacguguacagagaugaggcucugaacaauagguuccagaucaagggggucgaacucaaaagcggauacaaggacuggauucuguggaucucuuuugccauaucaugcuuccuucuguguguggcauugcucgguuuuaucaugugggccugccaaaaaggcaacauucgguguaauaucugcauuuga

SEQ ID NO: 127405 - RNA, 1701 nt, Artificial Sequence
  derived and/or modified sequence opt3 from hemagglutinin__InfluenzaA__ADK98876
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcaaaaacuguacccucauagacgcucugcuuggggauccgcagugcgacggauuucagaauaagaaaugggaucuguucguggaaagaagcaaggccuauuccaacuguuaccccuaugacgucccugauuacgcaucuuugaggucgcucguggccucaagcggcacucuggaguuuaauaacgaaaguuucaauuggacagguguuacccagaacgggacguccucugcuugcauccggcgcagcaaaaauuccuuuuucucacgacugaacuggcucacucauuuaaauuuuaaguauccagcacugaacgugaccaugcccaacaauggacaguucgacaaacuuuacauuuggggcguccaccauccuggcacagauaaggaccagaucuuuuuguaugcccaagcuagugggcguauuacugugagcaccaagagaucucagcagacaguaaucccaaacauaggauccaggccccggguucgcaauauuccuucaagaaucagcauuuacuggaccaucgugaaaccaggugauauccugcuaauuaacaguacgggcaaucucauagccccgaggggguacuucaagauccggucuggaaaguccagcauuaugcgcucggacgcgcccaucggcaaauguaacucugagugcauaacuccuaaugguuccauuccaaacgacaagcccuuucagaaugucaaccgaaucacauauggggcauguccuagauacgugaaacaaaauacccugaaacuugccacuggaaugaggaacgugccagagaagcagacacggggcaucuucggcgcuauugccggguuuaucgaaaauggaugggaggguauggucgauggcugguauggguuccgucaccagaacucagaaggacgcggccaagcagcugaccugaagaguacccaggccgcgauugaucagauaaaugguaaauugaacagacucaucgggaagacgaacgagaaguuccaccagauugagaaagaauuuagcgagguugaaggcaggauccaagaccuggagaaguacguggaagauaccaaaaucgacuuaugguccuauaaugccgagcugcucguagcacuugagaaccagcauacaauugaucugacugacucugaaaugaauaaguuguucgagaaaaccaagaagcagcuacgggaaaacgcugaggauaugggaaauggcugcuuuaaaauauaccacaagugugacaacgccugcaucgggagcauucgaaauggaacauaugaucaugacguguaccgcgacgaagcucugaacaauagauuccagaucaaaggugucgagcucaagucaggcuacaaagauuggauucuguggaucaguuuugccauauccugcuuccuucuguguguggcauugcucggguuuaucaugugggccugccaaaagggaaacauuagguguaauaucugcauuuga

SEQ ID NO: 127406 - RNA, 1701 nt, Artificial Sequence; identical to SEQ ID NO: 127380
  derived and/or modified sequence opt3 from hemagglutinin__InfluenzaA__ADK98887

SEQ ID NO: 127407 - RNA, 1701 nt, Artificial Sequence; identical to SEQ ID NO: 124450
  derived and/or modified sequence opt3 from hemagglutinin__InfluenzaA__ADK98898

SEQ ID NO: 127408 - RNA, 1701 nt, Artificial Sequence
  derived and/or modified sequence opt3 from hemagglutinin__InfluenzaA__ADK98909
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcauucggcgcagcaacaauuccuuuuucucacgacugaacuggcucacucauuuaaaguuuaaguauccagcacugaaugugaccaugcccaacaacgagcaguucgacaaacuuuacaucuggggaguccaccauccuggcacagauaaugaccagauuuuucuuuaugcccaagcuaguggccguaucacugugagcaccaagagaucucagcagacaguaauaccaaacauuggguccaggccccggguucgcaauaucccuucaagaauuagcaucuacuggaccaucgugaaaccaggagauauucugcuaauaaacaguacggguaaucucaucgccccgaggggcuacuucaagauucggucugggaaauccagcaucaugcgcucggacgcgcccauaggaaaguguaacucugaaugcauuacuccuaauggcuccaucccaaacgacaagcccuuucagaaugucaaccgaaucacauauggugcauguccuagauacgugaaacaaaauacccugaaguuggccacugggaugaggaacgugccagagaaacagacacggggaauuuucggcgcuaucgccggcuuuauugaaaaugggugggagggaauggucgaugguugguauggcuuccgucaccagaacucagaggggcgcggacaagcagcugaccugaagaguacccaggccgcgauagaucagaucaauggcaaauugaacagacucauugguaagacgaacgaaaaauuccaccagaucgagaaggaauuuagcgagguugaagggaggauccaagaccuggagaaguacguggaggauaccaaaauugacuuaugguccuauaaugccgaacugcucguagcacuugagaaccagcauacaauagaucugacugacucugaaaugaauaaguuguucgagaaaaccaagaaacagcuacgggaaaacgcugaggauaugggcaauggaugcuuuaagaucuaccacaagugugacaacgccugcauuggcagcauccgaaaugggacauaugaucaugacguguaccgcgacgaggcucugaacaauagauuccagauuaaaggagucgaacucaagucagguuacaaagauuggauccuguggauaaguuuugccaucuccugcuuccuucuguguguggcauugcucggcuuuauuaugugggccugccaaaaggggaacaucagguguaauauuugcaucuga

SEQ ID NO: 127409 - RNA, 1701 nt, Artificial Sequence
  derived and/or modified sequence opt3 from hemagglutinin__InfluenzaA__ADK98920
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagaggcaaggccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcauccggcgcagcaagaacuccuuuuucucacgacugaauuggcucacucauuuaaacuuuaaauauccagcacugaaugugaccaugcccaacaacgagcaguucgacaagcuguacauuuggggcguccaccauccuggcacagauaaagaccagaucuuuuuguaugcccaagcuagugggcguauuacugugagcaccaagagaucucagcagacaguaaucccaaauauaggauccaggccccggguucgcaacauuccuucaagaaucagcauuuacuggaccaucgugaaaccaggugauauccugcuaauuaauaguacgggcaaccucauagccccgaggggguacuucaagauccggucuggaaaguccagcauuaugcgcucggacgcgcccaucggcaaauguaauucugagugcauaacuccuaacgguuccauuccaaaugacaagcccuuucagaacgucaaucgaaucacauauggggcauguccuagauacgugaaacaaucaacccugaaacuugccacuggaaugaggaacgugccagaaaaacagacacggggcaucuucggcgcuauugccggguuuaucgagaauggaugggaagguauggucgauggcugguauggguuccgucaccagaacagugagggacgcggccaagcagcugaccuuaagagcacccaggccgcgauugaucagauaaaugguaaauugaacagacucaucgggaagacgaaugagaaguuccaccagauugaaaaagaguuuuccgaaguugagggcaggauccaagaccuggaaaaguacguggaggauaccaaaaucgacuuauggucuuauaacgccgagcugcucguagcacuugaaaaccagcauacaauugaucugacugacagcgagaugaauaaguuguucgaaaagaccaagaagcagcuacgggagaacgcugaagauaugggaaauggcugcuuuaaaauauaccacaagugugacaacgccugcaucgggucaauucgaaauggaacauaugaucaugacguguaccgcgacgaggcucugaacaauagauuccagaucaaaggugucgagcucaagaguggcuacaaagauuggauucuguggaucuccuuugccauaagcugcuuccuucuguguguggcauugcucggguuuaucaugugggccugccaaaagggaaacauuagguguaauaucugcauuuga

SEQ ID NO: 127410 - RNA, 1701 nt, Artificial Sequence; identical to SEQ ID NO: 124450
  derived and/or modified sequence opt3 from hemagglutinin__InfluenzaA__ADK98931

SEQ ID NO: 127411 - RNA, 1701 nt, Artificial Sequence
  derived and/or modified sequence opt3 from hemagglutinin__InfluenzaA__ADK98942
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucucaaacauagggagcaggccacggguucgcaauauucccaguagaaucucuauuuacuggaccaucgugaaaccuggagauauccugcuaauuaacuccacggguaaucucauagccccaaggggcuacuucaagauccggagcgggaaaucgucuauuaugcgcuccgacgcgccgaucggaaaguguaacucagaaugcauaacucccaauggcaguauuccuaacgacaagccauuucagaaugucaaccgaaucacauauggugcaugucccagauacgugaaacaaaauacccugaaacuugccacugggaugaggaacgugccugagaagcagacacggggaaucuucggcgcuauugccggcuuuaucgaaaaugggugggagggaauggucgaugguugguauggcuuccgucaccagaacagcgaggggcgcggacaagcagcugaccugaaguccacccaggccgcgauugaucagauaaauggcaaauugaacagacucaucgguaagacgaacgaaaaauuccaccagauugagaaggaauuuucugagguugaagggaggauccaagaccuggagaaguacguggaggauaccaaaaucgacuuauggagcuauaaugccgaacugcucguagcacuugagaaccagcauacaauugaucugacugacucagaaaugaauaaguuguucgagaaaaccaagaaacagcuacgggaaaacgcugaggauaugggcaauggaugcuuuaagauauaccacaagugugacaacgccugcaucggcaguauucgaaaugggacauaugaucauaacguguaccgcgacgaggcucugaauaacagauuccagaucaaaggagucgaacucaaguccgguuacaaagacuggauucuguggaucagcuuugccauaucuugcuuccuucuguguguggcauugcucggcuuuaucaugugggccugccaaaaggggaauauuagguguaacaucugcauuuga

SEQ ID NO: 127412 - RNA, 1701 nt, Artificial Sequence
  derived and/or modified sequence opt3 from hemagglutinin__InfluenzaA__ADK98953
augaagaccaucauugcccugagcuacaugcucugccuuguguucgcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacaggugagaucugcgacagcccacaccagauucuagauggcgaaaauuguacccucaucgacgcucugcuuggggauccgcagugcgacggauuucaaaacaaaaagugggaucuguucguggagagauccaaagccuauucuaauuguuaccccuaugacgucccugauuacgcaucguugaggucacucauagccagcaguggcacucuggaauuuaacaaugaguccuucaacuggacaggugugacccagaaugggacgucuagcgcuugcauccggcgcuccaacaauucauuuuucagucgacugaacuggcucacucauuuaaaguuuaaguauccagcacugaauguuaccaugcccaacaacgagcaguucgacaaacuuuacauuuggggagugcaccauccuggcacagauaaugaccagaucuuuuuguaugcccaagcuagcggccguauuacugucucuaccaagagaucccagcagacagugaucccaaacauagggucaaggccccggguacgcaauauuccuagcagaaucaguauuuacuggaccaucguuaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugugaaccgaaucacauauggugcauguccuagauacgucaaacaaaauacccugaagcuggccacugggaugaggaacgugccagagaaacagacacggggaaucuucggcgcuauugccggcuuuaucgaaaaugggugggagggaaugguggaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgaggucgaagggaggauccaagaccuggagaaguacguugaggauaccaaaaucgacuuauggucuuauaaugccgaacugcucguggcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguauaccgcgacgaggcucugaacaauagauuccagaucaaaggaguggaacucaagagugguuacaaagauuggauucuguggaucuccuuugccauaagcugcuuccuucugugugucgcauugcucggcuuuaucaugugggccugccaaaaggggaacauuagguguaauaucugcauuuga

SEQ ID NO: 127413 - RNA, 1701 nt, Artificial Sequence; identical to SEQ ID NO: 124450
  derived and/or modified sequence opt3 from hemagglutinin__InfluenzaA__ADK98964

SEQ ID NO: 127414 - RNA, 1701 nt, Artificial Sequence; identical to SEQ ID NO: 127367
  derived and/or modified sequence opt3 from hemagglutinin__InfluenzaA__ADK98975

SEQ ID NO: 127415 - RNA, 1701 nt, Artificial Sequence; identical to SEQ ID NO: 127412
  derived and/or modified sequence opt3 from hemagglutinin__InfluenzaA__ADK98986

SEQ ID NO: 127416 - RNA, 1701 nt, Artificial Sequence; identical to SEQ ID NO: 125629
  derived and/or modified sequence opt3 from hemagglutinin__InfluenzaA__ADK98997

SEQ ID NO: 127417 - RNA, 1701 nt, Artificial Sequence; identical to SEQ ID NO: 127412
  derived and/or modified sequence opt3 from hemagglutinin__InfluenzaA__ADK99008

SEQ ID NO: 127418 - RNA, 1701 nt, Artificial Sequence
  derived and/or modified sequence opt3 from hemagglutinin__InfluenzaA__ADK99030
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcguuucgacaagcuguacauuuggggaguccaccauccuggcacagauaaagaccagaucuuuuuguaugcccaggcuagcggcagaauuacugugucuaccaagaggucccaacagacaguaaucccaaauauagggucacggccccgcguuagaaacauuccuagcaggaucaguauuuacuggaccaucgugaaaccaggagauauccugcuaauuaauucuacggguaaccucauagccccgcggggcuacuucaagauccgcuccggaaagagcucgauuaugcgaucugacgcgcccaucgggaaauguaauuccgagugcauaacuccuaacggcucaauuccaaaugacaagcccuuucagaacgucaauagaaucacauauggugcauguccuagguacgugaaacagaacacccugaaacuugccacugggaugcggaaugugccagaaaaacaaacacguggaaucuucggcgcuauugccggcuuuaucgagaacgggugggaaggaauggucgaugguugguauggcuuccgccaccagaauagugaggggagaggacaggcagcugaccuuaagagcacccaagccgcgauugaucagauaaacggcaaauugaauaggcucaucgguaagacgaacgagaaguuccaccagauugaaaaagaguuuuccgaaguugaggggcggauccaggaccuggaaaaguacguggaggauaccaaaaucgacuuauggucuuauaacgccgagcugcucguagcacuugaaaaucaacauacaauugaucugacugacagcgagaugaacaaguuguucgaaaagaccaagaagcagcuacgagagaaugcugaagauaugggcaacggaugcuuuaaaauauaccacaagugugacaaugccugcaucggcucaauucgcaacgggacauaugaucaugacguguacagagacgaggcucugaauaacagguuccagaucaaaggagucgagcucaagagugguuacaaagauuggauucuguggaucuccuuugccauaagcugcuuccuucuguguguggcauugcucggcuuuaucaugugggccugccagaaggggaauauucgguguaacaucugcauuuga

SEQ ID NO: 127419 - RNA, 1701 nt, Artificial Sequence
  derived and/or modified sequence opt3 from hemagglutinin__InfluenzaA__ADK99041
augaagaccaucauugcccugagcuacauacucugccuuguguucgcucagaaacugcccggcaacgacaauuccacagcaacuuuguguuuagggcaccaugccgucccuaacggaacgaucguuaagaccauugcgaaugaucaaaucgaggugacaaacgcuacugaacugguacagucuucaaguaccggugagauuugcgacagcccacaccagauccuagauggcgaaaauuguacacucauagacgcccugcuuggggauccgcagugcgacggauuucaaaacaaaaagugggaucuguucguggagagauccaaagcauauucuaauuguuaccccuaugacgucccugauuacgccucguugaggucacucguggcuagcaguggcacccuggaauuuaacaaugaguccuucaacuggacugguguuacacagaaugggaccucuagcgcaugcauccggcgcuccaacaauucauuuuucagucgacugaacuggcucacgcauuuaaaguuuaaguauccagcccugaaugugacuaugcccaacaacgagcaguucgacaaacuuuacauuuggggaguccaccauccuggcaccgauaaugaccagaucuuuuuguaugcucaagccagcggccguauuacagugucuacuaagagaucccagcagaccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaauacacugaagcuggcuaccgggaugaggaacgugccagagaaacagacucggggaaucuucggcgccauugcaggcuuuaucgaaaaugggugggagggaauggucgaugguugguauggcuuccgucaccagaacagugaggggcgcggacaagcugccgaccuuaagagcacacaggcggccauugaucagauaaauggcaaauugaacagacucaucgguaagaccaacgaaaaauuccaccagauugagaaggaauuuuccgagguugaagggaggauccaagaccuggagaaguacguggaggauacgaaaaucgacuuauggucuuauaaugcagaacugcucguagcucuugagaaccagcauaccauugaucugacagacagcgaaaugaauaaguuguucgagaaaacuaagaaacagcuacgggaaaacgccgaggauaugggcaauggaugcuuuaagauauaccacaagugugacaacgcuugcaucggcucaauucgaaaugggaccuaugaucaugacguguaccgcgacgaggcccugaacaauagauuccagaucaaaggagucgaacucaagagugguuacaaagauuggauucuguggaucuccuuugcaauaagcugcuuccuucuguguguggccuugcucggcuuuaucaugugggcuugccaaaaggggaacauuagguguaauaucugcauuuga

SEQ ID NO: 127420 - RNA, 1701 nt, Artificial Sequence; identical to SEQ ID NO: 127367
  derived and/or modified sequence opt3 from hemagglutinin__InfluenzaA__ADK99063

SEQ ID NO: 127421 - RNA, 1701 nt, Artificial Sequence; identical to SEQ ID NO: 124450
  derived and/or modified sequence opt3 from hemagglutinin__InfluenzaA__ADK99085

SEQ ID NO: 127422 - RNA, 1701 nt, Artificial Sequence; identical to SEQ ID NO: 124450
  derived and/or modified sequence opt3 from hemagglutinin__InfluenzaA__ADK99096

SEQ ID NO: 127423 - RNA, 1701 nt, Artificial Sequence; identical to SEQ ID NO: 124450
  derived and/or modified sequence opt3 from hemagglutinin__InfluenzaA__ADK99107

SEQ ID NO: 127424 - RNA, 1701 nt, Artificial Sequence
  derived and/or modified sequence opt3 from hemagglutinin__InfluenzaA__ADK99118
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacaucccacaccagauacuagauggcaaaaauuguacccucaucgacgcucugcuuggggauccgcagugcgacggauuucaaaacaagaaaugggaucuguucguggaaagaagcaaggccuauuccaauuguuaccccuaugacgucccugauuacgcaucuuugaggucgcucguggccucaagcggcacucuggaguuuaacaaugaaaguuucaacuggacagguguuacccagaaugggacguccucugcuugcauucggcgcagcaagaacuccuuuuucucacgacugaauuggcucacucauuuaaacuuuaaauauccagcacugaaugugaccaugcccaacaacgagcaguucgacaagcuguacaucuggggaguccaccauccuggcacagauaaagaccagaucuuuuuguaugcccaagcuaguggccguauuacugugagcaccaagagaucucagcagacaguaauaccaaauauuggguccaggccccggguucgcaacaucccuucaagaauuagcaucuacuggaccaucgugaaaccaggagauauucugcuaauaaauaguacggguaaccucaucgccccgaggggcuacuucaagauucggucugggaaguccagcaucaugcgcucggacgcgcccauaggaaaauguaauucugagugcauuacuccuaacggcuccaucccaaaugacaagcccuuucagaacgucaaucgaaucacauauggugcauguccuagauacgugaaacaaucaacccugaaacuugccacugggaugaggaacgugccagaaaaacagacacggggaauuuucggcgcuaucgccggcuuuauugagaaugggugggaaggaauggucgaugguugguauggcuuccgucaccagaacagugaggggcgcggacaagcagcugaccuuaagagcacccaggccgcgauagaucagaucaauggcaaauugaacagacucauugguaagacgaaugagaaguuccaccagaucgaaaaagaguuuuccgaaguugaggggaggauccaagaccuggaaaaguacguggaggauaccaaaauugacuuauggucuuauaacgccgagcugcucguagcacuugaaaaccagcauacaauagaucugacugacagcgagaugaauaaguuguucgaaaagaccaagaagcagcuacgggagaacgcugaagauaugggcaauggaugcuuuaaaaucuaccacaaguguaacaaugccugcauuggcucaauccgaaacgggacauaugaccaugauguguaccgcgacgaggcucugaauaacagauuccagauuaaaggagucgagcucaagagugguuacaaagacuggauccuguggauauccuuugccaucagcugcuuccuucuguguguggcauugcucggcuuuauuaugugggccugccaaaaggggaauaucagguguaacauuugcaucuga

SEQ ID NO: 127425 - RNA, 1701 nt, Artificial Sequence
  derived and/or modified sequence opt3 from hemagglutinin__InfluenzaA__ADK99129
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaauaugaccaugcccaacaacgagcaguucgacaaacuuuacauuuggggagugcaccauccuggcacagauaaagaccagaucuuuuuguaugcccaagcuagcggccguauuacugucucuaccaagagaucccagcagacagugaucccaaauauagggucaaggccccggguacgcaacauuccuagcagaaucaguauuuacuggaccaucguuaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgugaaucgaaucacauauggugcauguccuagauacgucaaacaaaguacccugaaacuugccacugggaugaggaacgugccagaaaagcagacacggggaaucuucggcgcuauugccggcuuuaucgagaaugggugggaaggaaugguggaugguugguauggcuuccgucaccagaacagcgaggggcgcggacaagcagcugaccugaaguccacccaggccgcgauugaucagauaaauggcaaauugaacagacucaucgguaagacgaaugagaaguuccaccagauugaaaaagaguuuucugaagucgaggggaggauccaagaccuggaaaaguacguugaggauaccaaaaucgacuuauggagcuauaacgccgagcugcucguggcacuugaaaaccagcauacaauugaucugacugacucagagaugaauaaguuguucgaaaagaccaagaagcagcuacgggagaacgcugaagauaugggcaauggaugcuuuaaaauauaccacaaguguaacaaugccugcaucggcaguauucgaaacgggacauaugaccaugauguauaccgcgacgaggcucugaauaacagauuccagaucaaaggaguggagcucaaguccgguuacaaagacuggauucuguggaucagcuuugccauaucuugcuuccuucugugugucgcauugcucggcuuuaucaugugggccugccaaaaggggaauauuagguguaacaucugcauuuga

SEQ ID NO: 127426 - RNA, 1701 nt, Artificial Sequence; identical to SEQ ID NO: 127367
  derived and/or modified sequence opt3 from hemagglutinin__InfluenzaA__ADK99140

SEQ ID NO: 127427 - RNA, 1701 nt, Artificial Sequence
  derived and/or modified sequence opt3 from hemagglutinin__InfluenzaA__ADK99151
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggacugcaaaacaagaaaugggauuuguuuguggaaagauccaaggccuauucuaauuguuaccccuaugacgucccugauuacgcaucgcucaggucacugguggccagcaguggcacucuggaguucaacaaugaauccuuuaacuggacagguguuacccagaaugggacgucuagcgcuugcauccggcgcuccaagaacucauucuuuagucgacucaauugguuaacucaucugaacuucaaauauccagcacuuaaugugaccaugcccaacaacgagcaguuugacaaguuguacauuuggggaguccaccauccuggcacagauaaagaccagaucuuccuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccuacucauuaauucuacggguaaccugauagcgccgaggggcuacuuuaagauccgguccggaaagagcucgauuaugcgcucugacgcacccaucgggaaauguaauuccaagugcauaacuccuaacggcucaauuccaaaugacaaacccuuccagaacgugaaucgaaucacauauggugccuguccuagauacgucaagcaaaacacccuuaaacuggcuacugggaugaggaaugugccagagaagcagacacggggaaucuuuggcgccauugcaggcuucaucgaaaacgggugggagggaaugguggaugguugguauggcuuucgucaccagaauagugaagggcgcggacaagcugccgacuugaaaagcacccaggcggccauugaucagauaaacggcaagcucaauagacugaucgguaagacgaacgagaaauuccaccagauugagaaggaguucuccgaagucgaagggaggauccaagacuuagagaaauacguugaagauaccaagaucgaccuguggucuuauaacgcagagcuccuuguggcucuggagaaucagcauacaauugauuugacugacagcgaaaugaacaaacuauuugagaagaccaagaaacagcugcgggaaaaugccgaggauaugggcaacggaugcuucaagauauaccacaaaugugacaaugcuugcaucggcucaauucgaaacgggacauaugaucaugacguauaccgcgacgaagcccucaauaacagauuucagaucaagggaguggagcugaaaagugguuacaaggauuggauucuuuggaucuccuucgcaauaagcugcuuucuguugugugucgcccuccugggcuucaucaugugggcuugccaaaaggggaauauuagguguaacaucugcauuuga

SEQ ID NO: 127428 - RNA, 1701 nt, Artificial Sequence; identical to SEQ ID NO: 127367
  derived and/or modified sequence opt3 from hemagglutinin__InfluenzaA__ADK99162

SEQ ID NO: 127429 - RNA, 1701 nt, Artificial Sequence
  derived and/or modified sequence opt3 from hemagglutinin__InfluenzaA__ADK99173
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugauucagucuucaaguacaggugagaucugcgacagcccacaccagauacuagauggcgaaaauuguacccucaucgacgcucugcuuggggauccgcagugcgacggacugcaaaacaaaaagugggauuuguuuguagagagauccaaagccuauucuaauuguuaccccuaugacgugccugauuacgcaucgcucaggucacuggucgccagcaguggcacucuggaguucaacaaugaauccuuuaacuggacaggugugacccagaaugggacgucuagcgcuugcauucggcgcuccaacaauucauucuuuagucgacucaacugguuaacucaucugaaguucaaguauccagcacuuaauguuaccaugcccaacaacgagcaguuugacaaauuguacaucuggggagugcaccauccuggcacagauaaugaccagauuuuccuguaugcccaagcuagcggccguaucacugucucuaccaagagaucccagcagacagugauaccaaacauugggucaaggccccggguacgcaauaucccuagcagaauuaguaucuacuggaccaucguuaaaccaggagauauucuacucauaaacucuacggguaaucugaucgccccgaggggcuacuuuaagauucgguccgggaaaagcucgaucaugcgcucugacgcgcccauaggaaaguguaacuccgaaugcauuacuccuaauggcucaaucccaaacgacaagcccuuccagaaugugaaccgaaucacauauggugcauguccuagauacgucaaacaaaauacccuuaagcuggccacugggaugaggaacgugccagagaaacagacacggggaauuuuuggcgcuaucgccggcuucauugaaaaugggugggagggaaugguggaugguugguauggcuuucgucaccagaacagugaggggcgcggacaagcagcugaccucaagagcacccaggccgcgauagaucagaucaauggcaaauugaacagacugauugguaagacgaacgaaaaauuccaccagaucgagaaggaguucuccgaagucgaagggaggauccaagacuuagagaaguacguugaggauaccaaaauugaccuguggucuuauaaugccgaacuccuuguggcacuggagaaccagcauacaauagauuugacugacagcgaaaugaauaagcuauuugagaaaaccaagaaacagcugcgggaaaacgcugaggauaugggcaauggaugcuucaagaucuaccacaagugugacaacgccugcauuggcucaauccgaaaugggacauaugaucaugacguauaccgcgacgaggcucucaacaauagauuucagauuaaaggaguggaacugaagagugguuacaaagauuggauccuuuggauauccuucgccaucagcugcuuucuguugugugucgcacuccugggcuucauuaugugggccugccaaaaggggaacaucagguguaauauuugcaucuga

SEQ ID NO: 127430 - RNA, 1701 nt, Artificial Sequence
  derived and/or modified sequence opt3 from hemagglutinin__InfluenzaA__ADK99184
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcaauuccccacaccagauccuagacggcgaaaacuguacccucauagaugcucugcuuggggacccgcagugcgauggauuccaaaauaaaaagugggaccuguuuguggagagaucuaaagccuauucgaacuguuaccccuaugaugucccugacuacgcaucauugaggagccucguggccaguuccggcacucuggaguucaauaacgaaucuuuuaauuggacagguguuacccagaacgggacgagcuccgcuugcauccggcgcucaaauaacaguuucuuuagccgacugaauuggcucacucauuuaaaguucaaguauccagcacugaacgugaccaugcccaacaaugagcaguuugauaaacuuuacauuuggggaguccaccauccuggcacagacaacgaucagaucuucuuguaugcccaggcuucuggccguauuacuguguccaccaagagaucacaacagacaguaaucccaaauauagggagcaggccccggguucgcaacauuccuaguagaaucucuauuuacuggaccaucgugaaaccaggagacauccugcuaauuaauuccacggguaaccucauagccccgaggggcuacuuuaagauccggagcgggaaaucgucuauuaugcgcuccgaugcgcccaucggaaaguguaauucagaaugcauaacuccuaacggcaguauuccaaaugacaagcccuuccagaacgucaaucgaaucacauauggugcauguccuagauacgugaaacaaaacacccugaaacuugccacugggaugaggaaugugccagagaagcagacacggggaaucuuuggcgcuauugccggcuucaucgaaaacgggugggagggaauggucgacgguugguauggcuuucgucaccagaauagcgaggggcgcggacaagcagcugaucugaaguccacccaggccgcgauugaccagauaaacggcaaauugaacagacucaucgguaagacgaaugaaaaauuccaccagauugagaaggaguucucugaaguugaagggaggauccaagaucuggagaaguacguggaggacaccaaaaucgauuuauggagcuauaacgccgaacugcucguagcacuugagaaucagcauacaauugaccugacugauucagaaaugaacaaguuguuugagaaaaccaagaaacagcuacgggaaaaugcugaggacaugggcaacggaugcuucaagauauaccacaagugugauaaugccugcaucggcaguauucgaaacgggacauaugaccaugauguguaccgcgacgaggcucugaauaacagauuucagaucaaaggagucgaacucaaguccgguuacaaagacuggauucuguggaucagcuucgccauaucuugcuuucuucuguguguggcauugcucggcuucaucaugugggccugccaaaaggggaauauuagguguaacaucugcauuuga

SEQ ID NO: 127431 - RNA, 1701 nt, Artificial Sequence; identical to SEQ ID NO: 124450
  derived and/or modified sequence opt3 from hemagglutinin__InfluenzaA__ADK99195

SEQ ID NO: 127432 - RNA, 1701 nt, Artificial Sequence
  derived and/or modified sequence opt3 from hemagglutinin__InfluenzaA__ADK99206
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacaggugagaucugcgacagcccacaccagauucuagauggcaaaaauuguacccucaucgacgcucugcuuggggauccgcagugcgacggauuucaaaacaagaaaugggaucuguucgucgaaagauccaaggccuauucuaauuguuaccccuaugacgugccugauuacgcaucguugaggucacucguugccagcaguggcacucuggaguuuaacaaugaauccuucaacuggacaggugugacccagaaugggacgucuagcgcuugcauacggcgcuccaagaacucauuuuucagucgacugaauuggcucacucauuuaaacuuuaaauauccagcacugaaugucaccaugcccaacaacgagcaguucgacaagcuguacaucuggggagugcaccauccuggcacagauaaagaccagauuuuucuuuaugcccaagcuagcggccguaucacuguaucuaccaagagaucccagcagacaguuauuccaaauaucgggucaaggccccgggugcgcaacauaccuagcagagucaguauuuacuggaccaucgugaaaccaggagauauucugcuaaucaauucuacggguaaccucaucgccccgaggggcuacuucaagauucgguccgggaaaagcucgauaaugcgcucugacgcgcccaucggaaaauguaauuccgagugcauuacuccuaacggcucaaucccaaaugacaagcccuuucagaacgugaaucgaauaacauauggugcauguccuagauacgucaaacaaaacacccugaaguuggccacugggaugaggaauguuccagaaaaacagacacggggaauuuucggcgcuaucgccggcuuuaucgagaacgggugggaaggaaugguggaugguugguauggcuuccgucaccagaauagugaggggcgcggacaagcagcugaccuuaagagcacccaggccgcgauugaucagaucaacggcaaauugaauagacucauugguaagacgaacgagaaguuccaccagauagaaaaagaguuuuccgaaguagaggggaggauccaagaccuggaaaaguacguggaggauaccaaaauugacuuauggucuuauaacgccgagcugcucgucagccuugaaaaucagcauacaaucgaucugacugacucagagaugaacaaguuguucgaaaagaccaagaagcagcuacgggagaaugcagaagauaugggcaacggaugcuuuaaaaucuaccacaagugugacaaugcuugcauuggcaguauacgaaacgggacauaugaucaugacguguaccgcgacgaggcccugaauaacagauuccagaucaaaggaguugagcucaaguccgguuacaaagauuggauucuguggaucagcuuugcuauuucuugcuuccuucuguguguggccuugcucggcuuuaucaugugggcaugccaaaaggggaauauaagguguaacaucugcauuuga

SEQ ID NO: 127433 - RNA, 1701 nt, Artificial Sequence; identical to SEQ ID NO: 127367
  derived and/or modified sequence opt3 from hemagglutinin__InfluenzaA__ADK99217

SEQ ID NO: 127434 - RNA, 1701 nt, Artificial Sequence; identical to SEQ ID NO: 127367
  derived and/or modified sequence opt3 from hemagglutinin__InfluenzaA__ADK99228

SEQ ID NO: 127435 - RNA, 1701 nt, Artificial Sequence
  derived and/or modified sequence opt3 from hemagglutinin__InfluenzaA__ADK99239
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgucaaucgaaucacauauggugcauguccuagauacgugaaacaaaacacccugaaacuugccacugggaugaggaaugugccagaaaaacagacacggggaaucuucggcgcuauugccggcuuuaucgagaacgggugggaaggaauggucgaugguugguauggcuuccgucaccagaauagugaggggcgcggacaagcagcugaccuuaagagcacccaggccgcgauugaucagauaaacggcaaauugaauagacucaucgguaagacgaacgagaaguuccaccagauugaaaaagaguuuuccgaaguugaggggaggauccaagaccuggaaaaguacguggaggauaccaaaaucgacuuauggucuuauaacgccgagcugcucguagcacuugaaaaucagcauacaauugaucugacugacagcgagaugaacaaguuguucgaaaagaccaagaagcagcuacgggagaaugcugaagauaugggcaacggaugcuuuaaaauauaccacaagugugacaaugccugcaucggcucaauucgaaacgggacauaugaucaugacguguaccgcgacgaggcucugaauaacagauuccagaucaaaggagucgagcucaagagugguuacaaagauuggauucuguggaucuccuuugccauaagcugcuuccuucuguguguggcauugcucggcuuuaucaugugggccugccaaaaggggaauauuagguguaacaucugcauuuga

SEQ ID NO: 127436 - RNA, 1701 nt, Artificial Sequence
  derived and/or modified sequence opt3 from hemagglutinin__InfluenzaA__ADK99250
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagacaucgagaaguacguggaggauaccaaaauugaccuguggucuuauaaugccgaauuacugguagcacucgagaaccagcauacaauagaucuuacugacagcgaaaugaauaagcuguucgagaaaaccaagaaacaguugcgggaaaacgcugaggauaugggcaauggaugcuuuaagaucuaccacaagugugacaacgccugcauuggcucaauccgaaaugggacauaugaucaugacguguaccgcgacgaggcucuaaacaauagauuccagauuaaaggagucgaacugaagagugguuacaaagauuggauccucuggauauccuuugccaucagcugcuuccugcuuuguguggcacuguugggcuuuauuaugugggccugccaaaaggggaacaucagguguaauauuugcaucuga

SEQ ID NO: 127437 - RNA, 1701 nt, Artificial Sequence; identical to SEQ ID NO: 127367
  derived and/or modified sequence opt3 from hemagglutinin__InfluenzaA__ADK99261

SEQ ID NO: 127438 - RNA, 1701 nt, Artificial Sequence
  derived and/or modified sequence opt3 from hemagglutinin__InfluenzaA__ADK99283
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgucaaucgaaucacauauggugcauguccuagauacgugaaacaaaacacccugaaacuugccacugggaugaggaaugugccagaaaagcagacacggggaaucuucggcgcuauugccggcuuuaucgagaacgggugggaaggaauggucgaugguugguauggcuuccgucaccagaauagugaggggcgcggacaagcagcugaccuuaagagcacccaggccgcgauugaucagauaaacggcaaauugaauagacucaucgguaagacgaacgagaaguuccaccagauugaaaaagaguuuuccgaaguugaggggaggauccaagaccuggaacgguacguggaggauaccaagaucgacuuauggucuuauaacgccgagcugcucguagcacuugaaaaucagcauacaauugaucugacugacagcgagaugaacaaauuguucgaaaagaccaaaaagcagcuacgagagaaugcugaagauaugggcaacggaugcuuuaagauauaccacaaaugugacaaugccugcaucggcucaauucgcaacgggacauaugaucaugacguguacagagacgaggcucugaauaacagguuccagaucaagggagucgagcucaaaagugguuacaaggauuggauucuguggaucuccuuugccauaagcugcuuccuucuguguguggcauugcucggcuuuaucaugugggccugccaaaaagggaauauucgguguaacaucugcauuuga

SEQ ID NO: 127439 - RNA, 1701 nt, Artificial Sequence
  derived and/or modified sequence opt3 from hemagglutinin__InfluenzaA__ADK99294
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaagauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaaugugaccaugcccaacaacgagcaguucgauaagcuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagaaucaguauuuacuggacaaucgugaaaccaggagacauccugcuaauuaauucuaccgguaaccucauagcgccgaggggcuacuucaagauccgguccgggaaaagcucgauuaugcgcucugacgcacccaucggaaaguguaauuccgaaugcauaacgccuaacggcucaauuccaaaugauaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgacgguugguauggcuuccgucaccagaauagugaggggcgcggacaagcugccgaucuuaagagcacacaggcggccauugaccagauaaacggcaaauugaauagacucaucgguaagaccaacgaaaaauuccaccagauugagaaggaauuuuccgagguugaagggaggauccaagaucuggagaaguacguggaggacacgaaaaucgauuuauggucuuauaacgcagaacugcucguagcucuugagaaucagcauaccauugaccugacagauagcgaaaugaacaaguuguucgagaaaacuaagaaacagcuacgggaaaaugccgaggacaugggcaacggaugcuuuaagauauaccacaagugugauaaugcuugcaucggcucaauucgaaacgggaccuaugaccaugacguguaccgcgaugaggcccugaauaacagauuccagaucaaaggagucgaacucaagagugguuacaaagacuggauucuguggaucuccuuugcaauaagcugcuuccuucuguguguggccuugcucggcuuuaucaugugggcuugccaaaaggggaauauuagguguaacaucugcauuuga

SEQ ID NO: 127440 - RNA, 1701 nt, Artificial Sequence; identical to SEQ ID NO: 124450
  derived and/or modified sequence opt3 from hemagglutinin__InfluenzaA__ADK99305

SEQ ID NO: 127441 - RNA, 1701 nt, Artificial Sequence; identical to SEQ ID NO: 124450
  derived and/or modified sequence opt3 from hemagglutinin__InfluenzaA__ADL27989

SEQ ID NO: 127442 - RNA, 1701 nt, Artificial Sequence
  derived and/or modified sequence opt3 from hemagglutinin__InfluenzaA__ADL28000
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugaucaaauugaggugacuaacgcgaccgaacugguacagucuucaaguacaggugagaucugcgacagcccacaccagauucuagauggcaaaaauuguacccucaucgacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauacggcgcuccaagaacucauuuuucagucgacugaauuggcucacucauuuaaacuuuaaauauccagcacugaaugugaccaugcccaacaacgagcaguucgacaaguuguacaucuggggaguccaccauccuggcacagauaaagaccagauuuuucuuuaugcccaagcuagcgagcguaucacugugucuaccaagagaucccagcagacaguaauuccaaauaucggcucaaggccccggguucgcaacauaccuagcagaauuaguaucuacuggaccauugugaaaccaggggauauccugcuaaucaauucuacgggaaaccucauugccccgagggguuacuucaagauacgguccggcaagagcucgaucaugcgcucugacgcgcccauugggaaauguaauuccgaaugcaucacuccuaacggaucaauaccaaaugacaagcccuuucagaacgucaaucgaauuacauauggcgcauguccuagauacgugaaacaaaguacccugaaacuugccacugguaugaggaacgugccagagaagcagacacgggggaucuucggagcuaucgccggcuuuauugaaaauggcugggaggggauggucgauggaugguaugguuuccgucaccagaacagcgagggccgcgggcaagcagcugaccugaaguccacccaggccgcgaucgaucagauuaauggaaaauugaacagacucauaggcaagacgaaugaaaaguuccaccagaucgagaaagaauuuucugagguugaagguaggauucaagaccuggagaaguacguggaggauaccaaaaucgacuuauggagcuauaacgccgaacugcucguagcacuugagaaccagcauacaaucgaucugacugacucagaaaugaauaaguuguucgagaaaaccaagaagcagcuacgggaaaacgcugaggauauggggaauggcugcuuuaaaauuuaccacaagugugacaacgccugcauaggaaguauccgaaauggcacauaugaucaugacguguaccgcgacgaggcucugaacaauagauuccagauuaaaggggucgaacucaaguccggauacaaagauuggauccuguggauuagcuuugccaucucuugcuuccuucuguguguggcauugcucgguuuuauaaugugggccugccaaaagggcaacaucagguguaauauuugcaucuga

SEQ ID NO: 127443 - RNA, 1701 nt, Artificial Sequence
  derived and/or modified sequence opt3 from hemagglutinin__InfluenzaA__ADL28011
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccagaaggucccagcagacaguaaucccaaacauagggucacggccccgcguuagaaauauuccuagcaggaucaguauuuacuggaccaucgugaagccaggagauauccugcuaauuaacucuacggguaaucucauagccccgcggggcuacuucaaaauccgcuccggaaagagcucgauuaugcgaucugacgcgcccaucgggaaauguaacuccgaaugcauaacuccuaauggcucaauuccaaacgacaagcccuuucagaaugucaacagaaucacauauggugcauguccuagguacgugaagcaaaauacccugaaacuugccacugggaugcggaacgugccagagaagcagacacguggaaucuucggcgcuauugccggcuuuaucgaaaaugggugggagggaauggucgaugguugguauggcuuccgccaccagaacagugaggggagaggacaagcagcugaccugaaaagcacccaggccgcgauugaucagauaaauggcaaguugaacaggcucaucgguaaaacgaacgaaaaguuccaccagauugagaaagaauuuuccgagguugaagggcggauccaagaccuggagaaguacguggaggauaccaagaucgacuuauggucuuauaaugccgaacugcucguagcacuugagaaccagcauacaauugaucugacugacagcgaaaugaauaaauuguucgagaagaccaaaaagcagcuacgagaaaacgcugaggauaugggcaauggaugcuuuaaaauauaccacaagugugacaacgccugcaucggcucaauucgcaaugggacauaugaucaugacguguacagagacgaggcucugaacaauagguuccagaucaagggagucgaacucaaaagugguuacaaggauuggauucuguggaucuccuuugccauaagcugcuuccuucuguguguggcauugcucggcuuuaucaugugggccugccaaaaagggaacauucgguguaauaucugcauuuga

SEQ ID NO: 127444 - RNA, 1701 nt, Artificial Sequence; identical to SEQ ID NO: 127367
  derived and/or modified sequence opt3 from hemagglutinin__InfluenzaA__ADL28022

SEQ ID NO: 127445 - RNA, 1701 nt, Artificial Sequence; identical to SEQ ID NO: 124450
  derived and/or modified sequence opt3 from hemagglutinin__InfluenzaA__ADL28033

SEQ ID NO: 127446 - RNA, 1701 nt, Artificial Sequence; identical to SEQ ID NO: 125629
  derived and/or modified sequence opt3 from hemagglutinin__InfluenzaA__ADL28044

SEQ ID NO: 127447 - RNA, 1701 nt, Artificial Sequence
  derived and/or modified sequence opt3 from hemagglutinin__InfluenzaA__ADL28055
augaagaccaucguggcccugagcuacauucucugccuugucuucgcucagaaacugcccggcaacgacaauuccacagcaacuuuguguuuagggcaccaugccguuccuaacggaacgauagugaagaccaucacaaaugaucaaauugagguaacuaacgcgaccgaacuggugcagucuucaaguacaggugagaucugcgacagcccacaccagauucuagauggcgaaaauuguacccucaucgacgcucugcuuggggauccgcagugcgacggauuucaaaacaaaaagugggaucuguucgucgagagauccaaagccuauucuaauuguuaccccuaugacgugccugauuacgcaucguugaggucacucguugccagcaguggcacucuggaauuuaacaaugaguccuucaacuggacaggugugacccagaaugggacgucuagcgcuugcauacggcgcuccaacaauucauuuuucagucgacugaacuggcucacucauuuaaaguuuaaguauccagcacugaaugucaccaugcccaacaacgagcaguucgacaaacuuuacaucuggggagugcaccauccuggcacagauaaugaccagaucuuuuuguaugcccaagcuagcggccguauuacuguaucuaccaagagaucccagcagacaguuauuccaaacaucgggucaaggccccgggugcgcaauauaccuagcagaauuaguaucuacuggaccauugucaaaccaggagauauccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugugaaccgaauuacauauggugcauguccuagauacgugaaacaaaauacccugaagcuggccacugggaugaggaacgucccagagaaacagacacggggaaucuucggcgcuaucgccggcuuuauugaaaaugggugggagggaaugguugaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguggaagggaggauucaagaccuggagaaguacguagaggauaccaaaaucgacuuauggucuuauaaugccgaacugcucguggcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 127448 - RNA, 1701 nt, Artificial Sequence; identical to SEQ ID NO: 124450
  derived and/or modified sequence opt3 from hemagglutinin__InfluenzaA__ADL28066

SEQ ID NO: 127449 - RNA, 1701 nt, Artificial Sequence; identical to SEQ ID NO: 127367
  derived and/or modified sequence opt3 from hemagglutinin__InfluenzaA__ADL28077

SEQ ID NO: 127450 - RNA, 1701 nt, Artificial Sequence
  derived and/or modified sequence opt3 from hemagglutinin__InfluenzaA__ADL28088
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguauagccaagccucuggccguauuacuguguccaccaagagaucacagcagacaguaaucccaaacauagggagcaggccccggguucgcaauauuccuaguagaaucucuauuuacuggaccaucgugaaaccaggagauauccugcuaauuaacuccacggguaaucucauagcuccgaggggcuacuucaagauccggagcgggaaaucgucuauuaugcgcuccgacgcccccaucggaaaguguaacucagaaugcauaacuccuaauggcaguauuccaaacgacaagcccuuucagaaugucaaccgaaucacauauggugcguguccuagauacgugaaacaaaauacccugaaacuugcaacugggaugaggaacgugccagagaagcagacacggggaaucuucggcgccauugcuggcuuuaucgaaaaugggugggagggaauggucgaugguugguauggcuuccgucaccagaacagcgaggggcgcggacaagccgcagaccugaaguccacccaggcugccauugaucagauaaauggcaaauugaacagacucaucgguaagacgaacgaaaaauuccaccagauugagaaggaauuuucugagguugaagggaggauccaagaccuggagaaguacguggaggauaccaaaaucgacuuauggagcuauaaugcggaacugcucguagcccuugagaaccagcauacaauugaucugacugacucagaaaugaauaaguuguucgagaaaaccaagaaacagcuacgggaaaacgcagaggauaugggcaauggaugcuuuaagauauaccacaagugugacaacgcuugcaucggcaguauucgaaaugggacauaugaucaugacguguaccgcgacgaggcccugaacaauagauuccagaucaaaggagucgaacucaaguccgguuacaaagauuggauucuguggaucagcuuugcuauaucuugcuuccuucuguguguggccuugcucggcuuuaucaugugggcaugccaaaaggggaacauuagguguaauaucugcauuuga

SEQ ID NO: 127451 - RNA, 1701 nt, Artificial Sequence; identical to SEQ ID NO: 124450
  derived and/or modified sequence opt3 from hemagglutinin__InfluenzaA__ADL28099

SEQ ID NO: 127452 - RNA, 1701 nt, Artificial Sequence
  derived and/or modified sequence opt3 from hemagglutinin__InfluenzaA__ADL28110
augaagaccaucauugcccugagcuacauacucugccuuguguucgcucagaaacugcccggcaacgacaauuccacagcaacuuuguguaucgggcaccaugccgucccuaacggaacgauuguuaagaccaucacaaaugaucaaauugaggugacuaacgcgaccgaauuaguacaaaauucuucaacaggugagaucugcgacaguccacaccagauacuggauggcaaaaacuguacccuaaucgacgcucuccugggggauccgcagugcgacggauuucagaauaagaaaugggaucuuuucguggaaagaagcaaggccuauuccaacuguuaccccuaugacgucccugauuacgcaucucugaggucguugguggccucaagcggcacucucgaguuuaauaacgaaaguuucaauuggacagguguuacccagaacgggacguccucugcuugcauucggcgcagcaaaaauuccuuuuucucacgacugaacuggcugacucaucucaauuuuaaauauccagcauuaaacgugaccaugcccaacaaugagcaguucgacaagcuguacaucuggggaguccaccauccuggcacagauaaagaccagauuuuucuuuaugcccaagcuaguggccguaucacugugagcaccaagagaucucagcagacagccauaccaaacauuggguccaggccccggguacgcaauaucccuucaagaauuagcaucuacuggaccaucguuaaaccaggagauauuuugcugauaaacaguacggguaaucuaaucgcgccgaggggcuacuucaagauucggucugggaaguccagcaucaugcgcucggacgcacccauagacaaauguaacucugagugcauuacuccuaauggauccaucccaaacgauaagcccuuucagaaugugaaccgaaucacauauggcgccuguccuagauacgucaaacaaaauacccucaagcuggcuacugguaugaggaacgugccagaaaaacagacacgggggauuuucggagccaucgcaggcuuuauugagaauggcugggaagggaugguggacggaugguaugguuuccgucaccagaacucagagggccgcgggcaagcugccgaucuuaagaguacccaggcggccauagaccagaucaauggaaaacugaacagauugauuggcaagacgaacgagaaguuccaccagaucgaaaaagaguuuagcgaagucgaggguaggauccaagaucucgaaaaguacguugaggacaccaaaauugaucugugguccuauaaugcagaguuacugguggcucucgaaaaccagcauacaauagaccuuacugauucugagaugaauaagcuguucgaaaagaccaagaagcaguugcgggagaacgccgaagacauggggaauggcugcuuuaaaaucuaccacaagugugauaacgcuugcauuggaagcauccgaaauggcacauaugaccaugacguauaccgcgaugaggcccuaaacaauagauuccagauuaaagggguggagcugaagucaggauacaaagacuggauccucuggauaaguuuugcaaucuccugcuuccugcuuugugucgcccuguuggguuuuauuaugugggcuugccaaaagggcaacaucagguguaauauuugcaucuga

SEQ ID NO: 127453 - RNA, 1701 nt, Artificial Sequence
  derived and/or modified sequence opt3 from hemagglutinin__InfluenzaA__ADL28126
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuaaucagaacgggaccucuagcgcuugcauccggcgcuccaauaacucauuuuucagucgacugaauuggcucacgcauuuaaaguuuaaguauccagcacugaacgugacuaugcccaacaaugagcaguucgacaaacuuuacauuuggggaguccaccauccuggcaccgauaacgaccagaucuuuuuguaugcccaagcuagcggccguauuacagugucuacuaagagaucccagcagaccguaaucccaaauauagggucaaggccccggguucgcaacauuccuagcagaaucaguauuuacuggacaaucgugaaaccaggagauauccugcuaauuaauucuaccgguaaccucauagccccgaggggcuacuucaagauccgguccgggaaaagcucgauuaugcgcucugacgcgcccaucggaaaguguaauuccgaaugcauaacgccuaacggcucaauuccaaaugacaagcccuuucagaacgucaaucgaaucacuuauggugcauguccuagauacgugaaacaaaacacacugaagcuggccaccgggaugaggaaugugccagagaaacagacucggggaaucuucggcgcuauugccggcuuuaucgaaaacgggugggagggaauggucgaugguugguauggcuuccgucaccagaauagugaggggcgcggacaagcagcugaccuuaagagcacacaggccgcgauugaucagauaaacggcaaauugaacagacucaucgguaagaccaaugaaaaauuccaccagauugagaaggaauuuuccgagguugaagggaggauccaagaccuggagaaguacguggaggauacgaaaaucgacuuauggucuuauaacgccgaacugcucguagcacuugagaaucagcauaccauugaucugacagacagcgaaaugaacaaguuguucgagaaaacuaagaaacagcuacgggaaaaugcugaggauaugggcaacggaugcuuuaagauauaccacaagugugacaaugccugcaucggcucaauucgaaacgggaccuaugaucaugacguguaccgcgacgaggcucugaauaacagauuccagaucaaaggagucgaacucaagagugguuacaaagauuggauucuguggaucuccuuugccauaagcugcuuccuucuguguguggcauugcucggcuuuaucaugugggccugccaaaaggggaauauuagguguaacaucugcauuuga

SEQ ID NO: 127454 - RNA, 1701 nt, Artificial Sequence
  derived and/or modified sequence opt3 from hemagglutinin__InfluenzaA__ADL28137
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacggcccacaccagauccuagauggggaaaauuguacccucauagacgcucugcuuggagauccgcagugcgacggcuuccaaaacaaaaagugggaucuguuuguggagagauccaaagccuauucuaauuguuaccccuaugacgucccugauuacgcaucguugaggucacucguggccagcagugguacucuggaguucaacaaugaauccuuuaacuggacagggguuacccagaauggaacgucuagcgcuugcauccggcgcuccaacaauucauucuuuagucgacugaacuggcucacucauuuaaaguucaaguauccagcacugaaugugaccaugcccaacaacgagcaguuugacaaacuuuacauuuggggcguccaccauccuggcacagauaaugaccagaucuucuuguaugcccaagcuagcgggcguauuacugugucuaccaagagaucccagcagacaguaaucccaaacauaggaucaaggccccggguucgcaauauuccuagcagaaucaguauuuacuggaccaucgugaaaccaggugauauccugcuaauuaacucuacgggcaaucucauagccccgaggggguacuuuaagauccgguccggaaaaagcucgauuaugcgcucugacgcgcccaucggcaaguguaacuccgaaugcauaacuccuaaugguucaauuccaaacgacaagcccuuccagaaugucaaccgaaucacauauggggcauguccuagauacgugaaacaaaauacccugaagcuggccacuggaaugaggaacgugccagagaaacagacacggggcaucuuuggcgcuauugccggguucaucgaaaauggaugggaggguauggucgauggcugguauggguuucgucaccagaacagugagggacgcggccaagcagcugaccuuaagagcacccaggccgcgauugaucagauaaaugguaaauugaacagacucaucgggaagacgaacgaaaaauuccaccagauugagaaggaguucuccgaaguugaaggcaggauccaagaccuggagaaguacguggaggauaccaaaaucgacuuauggucuuauaaugccgaacugcucguagcacuugagaaccagcauacaauugaucugacugacagcgaaaugaauaaguuguuugagaaaaccaagaaacagcuacgggaaaacgcugaggauaugggaaauggcugcuucaagauauaccacaagugugacaacgccugcaucgggucaauucgaaauggaacauaugaucaugacguguaccgcgacgaggcucugaacaauagauuucagaucaaaggugucgaacucaagaguggcuacaaagauuggauucuguggaucuccuucgccauaagcugcuuucuucuguguguggcauugcucggguucaucaugugggccugccaaaagggaaacauuagguguaauaucugcauuuga

SEQ ID NO: 127455 - RNA, 1701 nt, Artificial Sequence; identical to SEQ ID NO: 124450
  derived and/or modified sequence opt3 from hemagglutinin__InfluenzaA__ADL28148

SEQ ID NO: 127456 - RNA, 1701 nt, Artificial Sequence; identical to SEQ ID NO: 127367
  derived and/or modified sequence opt3 from hemagglutinin__InfluenzaA__ADL28170

SEQ ID NO: 127457 - RNA, 1701 nt, Artificial Sequence; identical to SEQ ID NO: 124450
  derived and/or modified sequence opt3 from hemagglutinin__InfluenzaA__ADL28181

SEQ ID NO: 127458 - RNA, 1701 nt, Artificial Sequence; identical to SEQ ID NO: 127362
  derived and/or modified sequence opt3 from hemagglutinin__InfluenzaA__ADL28192

SEQ ID NO: 127459 - RNA, 1701 nt, Artificial Sequence; identical to SEQ ID NO: 127368
  derived and/or modified sequence opt3 from hemagglutinin__InfluenzaA__ADL28203

SEQ ID NO: 127460 - RNA, 1701 nt, Artificial Sequence; identical to SEQ ID NO: 125427
  derived and/or modified sequence opt3 from hemagglutinin__InfluenzaA__ADL28214

SEQ ID NO: 127461 - RNA, 1701 nt, Artificial Sequence
  derived and/or modified sequence opt3 from hemagglutinin__InfluenzaA__ADL28225
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguauagccaagccucuggccguauuacuguguccaccaagagaucacagcagacaguaaucccaaacauagggagcaggccccggguucgcaauauuccuaguagaaucucuauuuacuggaccaucgugaaaccaggagauauccugcuaauuaacuccacggguaaucucauagcuccgaggggcuacuucaagauccggagcgggaaaucgucuauuaugcgcuccgacgcccccaucggaaaguguaacucagaaugcauaacuccuaauggcaguauuccaaacgacaagcccuuucagaaugucaaccgaaucacauauggugcguguccuagauacgugaaacaaaauacccugaaacuugcaacugggaugaggaacgugccagagaagcagacacggggaaucuucggcgccauugcuggcuuuaucgaaaaugggugggagggaauggucgaugguugguauggcuuccgucaccagaacagcgaggggcgcggacaagccgcagaccugaaguccacccaggcugccauugaucagauaaauggcaaauugaacagacucaucgguaagacgaacgaaaaauuccaccagauugagaaggaauuuucugagguugaagggaggauccaagaccuggagaaguacguggaggauaccaaaacagacuuauggagcuauaaugcggaacugcucguagcccuugagaaccagcauacuaucgaucugaccgacucagaaaugaauaaguuguucgagaaaacaaagaaacagcuacgggaaaacgcagaggauaugggcaauggaugcuuuaagauuuaccacaagugugacaacgcuugcauaggcaguauccgaaaugggacuuaugaucaugacguguaccgcgacgaggcccugaacaauagauuccagauuaaaggagucgaacucaaguccgguuacaaagauuggauccuguggauuagcuuugcuaucucuugcuuccuucuguguguggccuugcucggcuuuauaaugugggcaugccaaaaggggaacaucagguguaauauuugcaucuga

SEQ ID NO: 127462 - RNA, 1701 nt, Artificial Sequence; identical to SEQ ID NO: 127367
  derived and/or modified sequence opt3 from hemagglutinin__InfluenzaA__ADL28236

SEQ ID NO: 127463 - RNA, 1701 nt, Artificial Sequence; identical to SEQ ID NO: 124450
  derived and/or modified sequence opt3 from hemagglutinin__InfluenzaA__ADL28247

SEQ ID NO: 127464 - RNA, 1701 nt, Artificial Sequence; identical to SEQ ID NO: 127380
  derived and/or modified sequence opt3 from hemagglutinin__InfluenzaA__ADL28258

SEQ ID NO: 127465 - RNA, 1701 nt, Artificial Sequence; identical to SEQ ID NO: 124450
  derived and/or modified sequence opt3 from hemagglutinin__InfluenzaA__ADL28370

SEQ ID NO: 127466 - RNA, 1701 nt, Artificial Sequence; identical to SEQ ID NO: 124685
  derived and/or modified sequence opt3 from hemagglutinin__InfluenzaA__ADL29672

SEQ ID NO: 127467 - RNA, 1701 nt, Artificial Sequence; identical to SEQ ID NO: 124927
  derived and/or modified sequence opt3 from hemagglutinin__InfluenzaA__ADL29682

SEQ ID NO: 127468 - RNA, 1701 nt, Artificial Sequence; identical to SEQ ID NO: 124685
  derived and/or modified sequence opt3 from hemagglutinin__InfluenzaA__ADL29692

SEQ ID NO: 127469 - RNA, 1701 nt, Artificial Sequence
  derived and/or modified sequence opt3 from hemagglutinin__InfluenzaA__ADL29702
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaagaucgaugacggguuccuggauaucuggaccuacaaugcugagcuccuuguccuguuggaaaacgagcgcacacuagacuaucaugauagcaaugugaaaaaccuguacgagaagguacgaaaccagcucaaaaauaacgccaaggaaauuggcaauggauguuuugaguucuaucacaagugcgacaacacuuguauggaaucaguuaaaaauggcaccuacgauuauccuaaguacagugaggaagcaaaacugaacagagaggagaucgacggggugaaacuugaauccacaaggauuuaucaaauacuggccaucuacagcaccgucgcuucuucauuggugcucgucgugagucugggagcgauuagcuuuuggaugugcuccaaugguucuuuacagugccggaucuguaucuga

SEQ ID NO: 127470 - RNA, 1701 nt, Artificial Sequence; identical to SEQ ID NO: 124685
  derived and/or modified sequence opt3 from hemagglutinin__InfluenzaA__ADL29730

SEQ ID NO: 127471 - RNA, 1701 nt, Artificial Sequence; identical to SEQ ID NO: 124685
  derived and/or modified sequence opt3 from hemagglutinin__InfluenzaA__ADL29740

SEQ ID NO: 127472 - RNA, 1701 nt, Artificial Sequence; identical to SEQ ID NO: 124685
  derived and/or modified sequence opt3 from hemagglutinin__InfluenzaA__ADL29750

SEQ ID NO: 127473 - RNA, 1701 nt, Artificial Sequence
  derived and/or modified sequence opt3 from hemagglutinin__InfluenzaA__ADL29760
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaauacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuucgucagauaacggaacuugcuacccaggcgacuuuaucgauuaugaggagcucagggagcagcugagcaguguguccucuuucgaacgguuugagauuuucccgaagacaagcuccuggcccaaucacgacucaaacaagggugucaccgccgcuuguccucaugcaggggccaaaaguuuuuacaagaaucugaucuggcucgugaaaaagggaaacagcuauccaaaauuaucuaaguccuacauaaaugauaagggcaaagaaguacugguucuuuggggcauccaccaccccucaacgagcgcugaccaacagaguuuguaccagaacgccgaugcguauguguucgucgggacuucucgcuacuccaagaaauuuaagccugagauugcaauccgaccaaaagugcgugaccaggagggaagaaugaauuauuacuggacccugguggaacccggugauaagauuacauucgaggccacuggcaaccuagucguuccuagguaugcuuuugccauggaacggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaucaccagaaugaacaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugaaaauuuaaacaaaaaggucgacgauggguuccuggacaucuggacuuauaaugccgagcuccuugugcuguuggaaaacgagcgcacccuagauuaccaugacagcaauguaaagaaccuguaugagaagguucgaucacagcucaaaaacaaugcaaaggaaaucggcaacggauguuuugaguucuaccacaagugcgauaauacauguauggaaagugugaaaaacggcacuuaugacuacccuaaguauuccgaggaagccaaacugaauagagaggagauugauggggucaaacuugaaagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 127474 - RNA, 1701 nt, Artificial Sequence; identical to SEQ ID NO: 124685
  derived and/or modified sequence opt3 from hemagglutinin__InfluenzaA__ADL29770

SEQ ID NO: 127475 - RNA, 1701 nt, Artificial Sequence; identical to SEQ ID NO: 126185
  derived and/or modified sequence opt3 from hemagglutinin__InfluenzaA__ADL29780

SEQ ID NO: 127476 - RNA, 1701 nt, Artificial Sequence
  derived and/or modified sequence opt3 from hemagglutinin__InfluenzaA__ADL29879
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuuccaaguauagcaaaaaguuuaaaccugagauugcgauccgcccaaaggugcgagaucaggagggacguaugaauuacuauuggacccugguggaacccggugacaaaauuacauucgaggcaacuggcaaccuagucguuccuagauacgccuuugcuauggaaaggaacgccgggucgggaaucauaauuucugauaccccagugcaugacugcaauacaaccugucaaacgccgaagggcgcaaucaacacuucccuccccuuccagaauauucacccuaucacaaucgguaagugcccaaaauauguaaagucaaccaaacugcggcuugcuacugggcugcgcaacgugcccaguauucagagcagaggauuguuuggcgccauagcgggcuucaucgaagggggauggacagguauggucgacggcugguacggguaucaucaccagaaugaacaaggauccggcuacgccgcagaucucaagucuacccagaacgcuauugacgagaucacgaauaaagugaacagcguuauagagaagaugaauacccaguuuacagccguggguaaggaauuuaaccaccuggagaaaaggauugaaaauuuaaacaagaaagucgaugacggguuccuggauaucuggacuuacaaugcugagcuccuugugcuguuggaaaacgagcggacccuagacuaucaugauucaaauguaaagaaccuguacgagaaaguucgcagucagcucaagaacaaugccaaggaaaucggcaacggauguuucgaguucuaucacaaaugcgacaauacauguauggaauccgugaagaacggcacuuacgauuauccuaaauacagcgaggaagcaaagcugaaucgagaggagauugacggggucaaacuugaaucuaccagaaucuaucaaauucuggccauauacucaacaguggcuaguagcuugguccucgugguuucccugggagcgaucucuuuuuggaugugcucgaacgguagcuuacagugcaggauuuguaucuga

SEQ ID NO: 127477 - RNA, 1701 nt, Artificial Sequence
  derived and/or modified sequence opt3 from hemagglutinin__InfluenzaA__ADL32017
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuaugucagcucagaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcaacugagcaguguguccucuuucgaacgguuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucagcagaguuuguaccagaacgccgacacuuacguguucgucgggaccucucgcuauuccaaaaaguuuaaaccugagauugcgauccgaccaaaggugcgugaucaagagggaagaaugaauuacuauuggacacugguggaacccggugacaaaauuacuuucgaggcaaccggcaaccuagucguuccuagguacgccuuugcuauggaacggaacgccgggagcggaaucauaauuucggauacaccagugcaugacugcaauaccacgugucagacuccgaagggcgcaaucaacacaucucuccccuuccagaauauucacccuaucaccaucgguaaaugcccaaaguauguaaaguccacuaaacugcgccuugcuacagggcugagaaacgugcccucaauucagaguaggggauuguuuggcgccauagcgggcuucaucgaagggggauggaccgguauggucgacggcugguacggguaucaucaccaaaaugaacagggaagcggcuacgccgcagaucucaaguccacgcagaacgcuauugacgagaucaccaauaaagugaacucuguuauagagaagaugaauacacaguuuacugccguggguaaagaguucaaccaccuggaaaagcggauugaaaauuuaaacaagaaaaucgaugacggguuccuggauaucuggaccuacaaugcugagcuccuuguccuguuggaaaacgagcgcacacuagacuaucaugauagcaaugugaagaaccuguacgagaaaguacgaucacaacucaagaacaaugccaaagaaauuggcaacggauguuuugaguucuaucacaagugcgacaauacuuguauggaaaguguuaagaacggcaccuacgauuauccuaaauacuccgaggaagcaaagcugaauagagaggagaucgacggggugaaacuugaaagcacaaggauuuaucagauacuggccaucuacucuaccgucgcuucaaguuuggugcucgucgugagccugggagcgauuuccuuuuggaugugcucuaacgguucguuacagugccggaucuguaucuga

SEQ ID NO: 127478 - RNA, 1701 nt, Artificial Sequence
  derived and/or modified sequence opt3 from hemagglutinin__InfluenzaA__ADL32037
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcguggaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacgagaucacgaauaagguuaacucugugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagauugacggggugaaacuugaaagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 127479 - RNA, 1701 nt, Artificial Sequence; identical to SEQ ID NO: 124685
  derived and/or modified sequence opt3 from hemagglutinin__InfluenzaA__ADL32047

SEQ ID NO: 127480 - RNA, 1701 nt, Artificial Sequence
  derived and/or modified sequence opt3 from hemagglutinin__InfluenzaA__ADL32057
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagggguuguaccagaacgccgacgcguacguguucgucggaaccagucgcuauucuaagaaauuuaagccugagauugcaauccgaccaaaagugcgugaucaggaggguagaaugaauuacuauuggacucugguggaacccggcgacaagauuacauucgaggccacugggaaccuagucguuccuagguacgcuuuugccauggaacggaacgcaggauccggcaucauaauuagcgauaccccagugcaugacugcaauacaaccugucaaacgccgaaaggugcuaucaacacuucgcuccccuuccagaauauucacccuaucacaaucgggaagugcccaaaguauguaaaaggaaccaagcugcgccuugccacuggccugagaaacgugcccucuauucaguccaggggcuuguuuggggcgauagccggauucaucgaggguggcuggacagggauggucgacggaugguacggcuaucaucaccagaaugaacaagguucaggguacgcagcugaucucaaaaguacccagaacgccauugacgagaucacgaauaaggugaacagcguuauagagaaaaugaauacccaguuuacagcugugggcaaggaguucaaccaccuggagaagcggauugaaaauuuaaacaaaaaggucgaugacggauuccuggauaucuggacuuacaaugccgagcuccuugugcuguuggaaaacgagcgcacccuagacuaucaugauuccaauguaaagaaccuguacgagaagguucgaucucagcucaaaaacaaugcaaaggaaaucggcaacggguguuuugaguucuaucacaagugcgacaauacauguauggaaagcgugaaaaacggaacuuacgauuauccuaaguacucagaggaagccaaacugaauagagaggagauugacggugucaaacuugaaaguaccaggaucuaucaaauucuggcuauauacuccacaguggcgagcucuuugguccucgugguuucacugggcgcaaucaguuuuuggaugugcagcaacggguccuuacagugccggauuuguaucuga

SEQ ID NO: 127481 - RNA, 1701 nt, Artificial Sequence; identical to SEQ ID NO: 124685
  derived and/or modified sequence opt3 from hemagglutinin__InfluenzaA__ADL32090

SEQ ID NO: 127482 - RNA, 1701 nt, Artificial Sequence; identical to SEQ ID NO: 124685
  derived and/or modified sequence opt3 from hemagglutinin__InfluenzaA__ADL32114

SEQ ID NO: 127483 - RNA, 1701 nt, Artificial Sequence; identical to SEQ ID NO: 124685
  derived and/or modified sequence opt3 from hemagglutinin__InfluenzaA__ADL32344

SEQ ID NO: 127484 - RNA, 1701 nt, Artificial Sequence; identical to SEQ ID NO: 125132
  derived and/or modified sequence opt3 from hemagglutinin__InfluenzaA__ADL32354

SEQ ID NO: 127485 - RNA, 1701 nt, Artificial Sequence
  derived and/or modified sequence opt3 from hemagglutinin__InfluenzaA__ADL32364
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaauuaguuggagcuacaucguugagaccuccucuucggacaacggaacuugcuauccaggcgauuuuauugacuacgaggagcucagggagcagcugucaagcgugaguuccuucgaacgguuugagaucuucccgaagacaucuagcuggcccaaucacgauuccaacaagggugucaccgccgcuuguccucaugcaggggccaaaucauuuuauaagaaucugauauggcucgugaaaaagggaaacaguuacccaaaauuaagcaagucuuauaucaaugacaagggcaaagaaguacugguucuuuggggcauucaccaccccuccacgucagcugaucaacagagcuuguaccagaacgccgacacuuacguguucgucgggaccagucgcuauucuaagaaauuuaagccugagaucgcgauucgaccaaaagugcgugaucaggagggaagaaugaauuacuauuggacacugguggaacccggugacaagaucacuuucgaggcaaccggcaaccuagucguuccuagguacgccuuugcuauggaacggaacgccggguccggaauaauuaucagcgauacaccagugcaugacugcaauaccacgugucaaacuccgaaaggcgcaauuaacacaucgcuccccuuccagaauauccacccuaucaccauugguaagugcccaaaguauguaaaaucuacuaagcugcgccuugcuacagggcugagaaacgugcccuccauacagucaaggggauuguuuggcgccaucgcgggcuucauugaagggggauggaccgguauggucgacggcugguacggguaucaucaccagaaugaacaaggaaguggcuacgccgcagaucucaaaagcacgcagaacgcuaucgacgagauaaccaauaaggugaacuccguuauugagaaaaugaauacacaguuuacugccguggguaaggaguucaaccaccuggaaaagcggaucgaaaauuuaaacaaaaagaucgaugacggguuccuggauauuuggaccuacaaugcugagcuccuuguccuguuggaaaacgagcgcacacuagacuaucaugauucuaaugugaaaaaccuguacgagaagguacgaagccagcucaaaaacaaugccaaggaaaucggcaacggauguuuugaguucuaucacaagugcgacaauacuuguauggaaucaguuaaaaacggcaccuacgauuauccuaaguacagugaggaagcaaaacugaauagagaggagauugacggggugaaacuugaauccacaaggauauaucaaauccuggccauuuacagcaccgucgcuucuucauuggugcucgucgugagucugggagcgaucagcuuuuggaugugcuccaacgguucuuuacagugccggaucuguauuuga

SEQ ID NO: 127486 - RNA, 1701 nt, Artificial Sequence; identical to SEQ ID NO: 124685
  derived and/or modified sequence opt3 from hemagglutinin__InfluenzaA__ADL32374

SEQ ID NO: 127487 - RNA, 1701 nt, Artificial Sequence
  derived and/or modified sequence opt3 from hemagglutinin__InfluenzaA__ADL32384
augaaggccauccuggugguccuccuuuacaccuucgcuacagcaacugccgacacgcugugcauuggcuaucacgcgaacaauagcaccgauacaguugacacuguguuggagaagaacguaaccgugacacauuccgucaauuuacuggaagauaagcacaacgggaaacuauguaagcucagaggaguggcuccccugcaucuugguaaaugcaauauagccggcuggauccuggggaacccugagugugaaucuuugucaaccgcaaguagcugguccuacauuguugagacuucuucgucagacaauggaacaugcuauccaggcgauuuuaucgacuacgaggagcucagggagcagcugagcaguguguccucuuucgaacgguuugagauuuucccgaagaccagcuccuggcccaaccacgauucaaauaagggugucacggccgcuuguccucaugcaggggccaaaaguuuuuauaagaaccugaucuggcucgugaaaaagggaaauagcuacccaaaauuaucuaaguccuauauaaacgacaagggcaaagaaguacugguucuuuggggcauccaccaccccucaacuagcgcugaucaacagaguuuguaccagaaugccgacgcguacguguucgucgggaccucucgcuauuccaagaaauuuaagccugagauugcaauccgaccaaaagugcgugaucaggagggaagaaugaacuacuauuggacacugguggaacccggugacaagauuacuuucgaggccaccggcaaucuagucguuccuagguacgcuuuugccauggaacggaacgcagggagcggaaucauaauuucggauacaccagugcaugacugcaacaccacgugucaaacuccgaaaggcgcuaucaauacaucucuccccuuccagaacauucacccuaucaccaucgguaagugcccaaaguauguaaaauccacuaagcugcgccuugccacagggcugagaaaugugcccucaauucagaguaggggauuguuuggcgcgauagccggcuucaucgaagggggauggaccgguauggucgacggcugguacggguaucaucaccagaacgaacaaggaagcggcuacgcagcugaucucaaauccacgcagaaugccauugacgagaucaccaacaagguaaauucuguuauagagaaaaugaacacacaguuuacugcuguggguaaggaguucaaucaccuggaaaagcggauugaaaacuuaaauaaaaaggucgaugacggguuccuggauaucuggaccuacaacgccgagcuccuugugcuguuggaaaaugagcgcacacuagacuaucaugauagcaacgugaaaaaucuguacgagaagguucgaucacagcucaaaaacaacgcaaaggaaaucggcaauggauguuuugaguucuaucacaagugcgacaacacuuguauggaaagugugaaaaauggcaccuacgauuauccuaaguacuccgaggaagccaaacugaacagagaggagauugacggggucaaacuugaaagcacaaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 127488 - RNA, 1701 nt, Artificial Sequence
  derived and/or modified sequence opt3 from hemagglutinin__InfluenzaA__ADL32394
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaccaguagcugguccuacauuguugagacuucuucgucagacaacggaacaugcuauccaggcgauuucaucgacuacgaagaguugagggagcagcucagcaguguguccucuuuugaacgguucgagauuuuuccgaagaccagcuccuggcccaaucacgauucaaacaagggugucacggcagccuguccucaugcuggggcaaaaaguuucuauaagaaucugaucuggcuggugaaaaagggaaacagcuacccaaaacucucuaaguccuauauaaaugacaagggcaaagaaguauuaguucuguggggcauccaccaccccucaacuagcgccgaucaacagagucuuuaccagaacgcugacaccuacguguuugucgggacaucucgcuauuccaagaaauucaagccugagauugccauccgaccaaaagugcgugaucaggagggaagaaugaauuacuauuggacuuugguggaacccggugacaagauuaccuuugaggcgacaggcaaccuggucguuccuagguacgcauucgccauggaacggaacgcugggagcggaaucauaauuucggauaccccagugcaugacugcaauacgacuugucaaacaccgaaaggcgccaucaacaccucucuacccuuucagaauauucacccuaucacuaucgguaagugcccaaaguauguaaaauccacaaagcuccgccuggcaaccgggcuuagaaacgugcccucaauucagaguaggggacuguucggcgcuauagccggcuuuaucgaagggggauggacggguauggucgacggcugguacggguaucaucaccagaaugaacaaggaagcggcuacgcggccgauuugaaauccacccagaacgcaauugacgagaucacaaauaaggugaacucuguuauagagaaaaugaauacucaguucaccgcuguggguaaggaguucaaccaccucgagaagcggauugaaaaucugaacaaaaagaucgaugacggguuuuuagauaucuggacauacaaugccgagcugcucguccuucuggaaaacgagcgcacuuuggacuaucaugauagcaaugugaaaaaccuauacgagaagguacgaucacagcugaaaaacaaugcuaaggaaauuggcaacggauguuucgaguuuuaucacaagugcgacaauaccuguauggaaaguguuaaaaacggcacauacgauuauccuaaguacuccgaggaagccaaacucaauagagaggagaucgacggggugaagcuggaaagcaccaggauuuaucaaauacuugcaaucuacucuacugucgccucaagucugguguuggucgugagccucggagcuauuuccuucuggaugugcucuaacgguucgcugcagugccggaucuguaucuga

SEQ ID NO: 127489 - RNA, 1701 nt, Artificial Sequence; identical to SEQ ID NO: 124685
  derived and/or modified sequence opt3 from hemagglutinin__InfluenzaA__ADL32404

SEQ ID NO: 127490 - RNA, 1701 nt, Artificial Sequence
  derived and/or modified sequence opt3 from hemagglutinin__InfluenzaA__ADL32414
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugcccaggagggaagaaugaauuacuauuggacccugguggaacccggugauaagauuacauucgaggcuacuggcaaccuagucguuccuagguacgccuuugcaauggaacggaacgcugggagcggaaucauaauuucggacaccccagugcaugauugcaauacaaccugucaaacgccgaaaggcgccaucaacacuucucuccccuuccagaauauucacccuaucacaaucgguaagugcccaaaguauguaaaauccaccaagcugcgccuugcgacugggcugagaaacgugcccucaauucagaguaggggauuguuuggcgccauagcaggcuucaucgaagggggauggacagguauggucgacggcugguacggguaucaucaccagaaugaacaaggaagcggcuacgcugccgaccucaaauccacccagcacgcuauugaugagaucacgaacaagguaaauucuguuauagagaaaaugaacacccaguuuacagccguggguaaggaguucaaucaucuggaaaagcggauugaaaacuuaaauaaaaaggucgacgauggguuccuggacaucuggacuuacaacgcagagcuccuugugcuguuggaaaaugagcgcacccuagauuaucacgacagcaacgugaaaaaucuguacgagaagguucgaucacagcucaaaaacaacgccaaggaaaucggcaauggauguuuugaguucuaucauaagugcgauaacacauguauggaaagugugaaaaauggcacuuacgacuauccuaaguacuccgaggaagcuaaacugaacagagaggagauugauggggucaaacuugaaagcaccaggaucuaucaaauucuggcgauauacucuacaguggcaucaaguuugguccucgugguuagccugggagccaucuccuuuuggaugugcucuaaugguucguuacagugccggauuuguaucuga

SEQ ID NO: 127491 - RNA, 1701 nt, Artificial Sequence
  derived and/or modified sequence opt3 from hemagglutinin__InfluenzaA__ADL32424
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuaccauuggacucugguggaacccggugacaagaucaccuucgaggccacaggcaaccuagucguuccuagguaugcuuuugccauggaacggaacgcagggagcggaauaauuaucucggauacuccagugcacgacugcaauaccacaugucaaaccccgaaaggcgcuauuaacacgucucuccccuuccagaauauccauccuaucacuauugguaagugcccaaaguacguaaaauccacaaagcugcgccuugccaccgggcugagaaacgugcccucaauacagaguaggggauuguuuggcgcgaucgccggcuucauugaagggggauggacugguauggucgacggcugguauggguaccaccaccagaaugaacaaggaagcggcuaugcagcugaucucaaauccacacagcaugccaucgacgagauaaccaacaagguaaauucuguuauugagaaaaugaacacgcaguuuaccgcuguggguaaggaguucaaucaccuggaaaagcggaucgaaaacuuaaauaaaaaggucgaugacggguuccuggauaucuggacauacaacgccgagcuccuugugcuguuggaaaaugagcgcacucuagacuaccaugauagcaacgugaaaaaucuguaugagaagguucgaucacagcucaaaaacaacgcaaaggaaauuggcaauggauguuuugaguucuaccacaagugcgacaacaccuguauggaaagugugaaaaauggcacauaugauuacccuaaguauuccgaggaagccaaacugaacagagaggagaucaauggggucaaacuugaaagcacuaggauuuaccaaauacuggcuaucuauucuaccguggcgucaaguuugguccucgugguuagccugggagcaauuuccuuuuggaugugcucuaacgguucguuacagugccggaucuguaucuga

SEQ ID NO: 127492 - RNA, 1701 nt, Artificial Sequence
  derived and/or modified sequence opt3 from hemagglutinin__InfluenzaA__ADL32434
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccauccacgauucaaauaagggugucaccgccgcuuguccucaugcaggggccaaaaguuuuuauaagaaccugauauggcucgugaaaaagggaaauagcuacccaaaauuaucuaaguccuauaucaacgacaagggcaaagaaguacugguucuuuggggcauucaccaccccucaacgagcgcugaucaacagaguuuguaccagaaugccgacgcguacguguucgucgggacuucucgcuauuccaagaaauuuaagccugagaucgcaauucgaccaaaagugcgugaucaggagggaagaaugaacuacuauuggauccugguggaacccggugacaagauaaccuucgaggccacaggcaaucuagucguuccuagguacgcuuuugccauggaacggaacgcagggagcggaauuaucauuucggauacuccagugcaugacugcaacaccacaugucaaaccccgaaaggcgcuaucaauacgucucuccccuuccagaacauccacccuauuacuauagguaagugcccaaaguauguaaaauccacaaagcugcgccuugccaccgggcugagaaaugugcccucaauccagaguaggggauuguuuggcgcgauugccggcuucaucgaagggggauggacugguauggucgacggcugguacggguaucaucaccagaacgaacaaggaagcggcuacgcagcugaucucaaauccacacagcacgccauagacgagauuaccaauaaggugaacucuguuaucgagaaaaugaauacgcaguuuaccgcuguggguaaggaguucaaccaucuggaaaagcggaucgaaaauuuaaacaaaaaggucgaugacggguuccuggauauuuggacauacaaugccgagcuccuugugcuguuggaaaacgagcgcacucuagacuaucacgauagcaauguaaagaaccuguacgagaagguucgaucacagcucaaaaauaacgcaaaggaaaucggcaacggauguuuugaguucuaucauaagugcgacaauaccuguauggaaagugugaaaaacggcacauacgauuauccuaaguacuccgaggaagccaaacugaauagagaggagauugacggggucaaacuugaaagcacuaggauauaucaaauccuggcuauuuacucuaccguggcgucaaguuugguccucgugguuagccugggagcaaucuccuuuuggaugugcucuaacgguucguuacagugccggaucuguauuuga

SEQ ID NO: 127493 - RNA, 1701 nt, Artificial Sequence; identical to SEQ ID NO: 126105
  derived and/or modified sequence opt3 from hemagglutinin__InfluenzaA__ADL32444

SEQ ID NO: 127494 - RNA, 1701 nt, Artificial Sequence
  derived and/or modified sequence opt3 from hemagglutinin__InfluenzaA__ADL32454
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagcugggcaacggauguuuugaguucuaucauaagugcgacaauaccuguauggaauccgugaagaacggcacauacgauuauccuaaauacagcgaagaggccaaacuuaauagagaggaaaucgacggggucaagcuggagucuacuaggauuuaucagaucuuggcuauuuacucaaccguggcgaguagccucguccuggugguuuccuuaggagcaauaucuuuuuggaugugcucgaacgguagccugcaaugccggaucuguauuuga

SEQ ID NO: 127495 - RNA, 1701 nt, Artificial Sequence; identical to SEQ ID NO: 126852
  derived and/or modified sequence opt3 from hemagglutinin__InfluenzaA__ADL32464

SEQ ID NO: 127496 - RNA, 1701 nt, Artificial Sequence; identical to SEQ ID NO: 126852
  derived and/or modified sequence opt3 from hemagglutinin__InfluenzaA__ADL32484

SEQ ID NO: 127497 - RNA, 1701 nt, Artificial Sequence
  derived and/or modified sequence opt3 from hemagglutinin__InfluenzaA__ADL32504
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaaugugcuauccaggcgauuuuaucgacuacgaggagcucagggagcagcugagcaguguguccucuuucgaacgguuugagauuuucccgaagacuagcuccuggcccaaucacgauucaaacaagggugucacagccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgcugaucaacagaguuuguaccagaacgccgacgcguacguguucgucgggacgucucgcuauuccaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggagcggaaucauaauuucggauacuccagugcaugacugcaauaccacaugucaaaccccgaaaggcgcuaucaacacgucucuccccuuccagaauauucacccuaucacuaucgguaagugcccaaaguauguaaaauccacaaagcugcgccuugccaccgggcugagaaacgugcccucaauucagaguaggggauuguuuggcgcgauagccggcuucaucgaagggggauggacugguauggucgacggcugguacggguaucaucaccagaaugaacaaggaagcggcuacgcagcugaucucaaauccacacagcacgccauugacgagaucaccaacaagguaaauucuguuauagagaaaaugaacacgcaguuuaccgcuguggguaaggaguucaaucaucuggaaaagcggauugaaaacuuaaauaaaaaggucgaugacggguuccuggauaucuggacauacaacgccgagcuccuugugcuguuggaaaaugagcgcacucuagacuaucacgauagcaacgugaaaaaucuguacgagaagguucgaucacagcucaaaaacaacgcaaaggaaaucggcaauggauguuuugaguucuaucauaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 127498 - RNA, 1701 nt, Artificial Sequence; identical to SEQ ID NO: 126105
  derived and/or modified sequence opt3 from hemagglutinin__InfluenzaA__ADL32514

SEQ ID NO: 127499 - RNA, 1701 nt, Artificial Sequence; identical to SEQ ID NO: 126852
  derived and/or modified sequence opt3 from hemagglutinin__InfluenzaA__ADL32524

SEQ ID NO: 127500 - RNA, 1701 nt, Artificial Sequence
  derived and/or modified sequence opt3 from hemagglutinin__InfluenzaA__ADL32544
augaaggccauccuggugguccuccuuuacaccuucgcuacaagcaacgcagacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuacgcaaguccuauauaaaugacaagggcaaagaaguacugguucuuuggggcauccaccaccccucaacgagcgccgaucaacagaguuuguaccagaacgcugacgccuacguguucgucgggacuucucgauauuccaagaaauuuaagccugagauugcgauccguccaaaagugagagaucaggagggaaggaugaauuacuauuggacccugguggaacccggugacaagauuacauucgaggcaacuggcaaccuagucguuccucgguacgccuuugcuauggaacgcaacgccgggagcggaaucauaauuucggauaccccagugcaugacugcaauacaaccugucaaacgccgaaaggcgcaaucaacacuucucuccccuuccagaauauucacccuaucacaaucgguaagugcccaaaguauguaaaauccaccaagcugagacuugcuacugggcugaggaacgugcccucaauucagagucggggauuguuuggcgccauagcgggcuucaucgaagggggauggacagguauggucgacggcugguacggguaucaucaccagaaugaacaaggaagcggcuacgccgcagaucucaaauccacccagcacgcuauugacgagaucacgaacaagguaaauucuguuauagagaaaaugaacacccaguuuacagccguggguaaggaguucaaucaucuggaaaagcgcauugaaaacuuaaauaaaaaggucgaugacggguuccuggauaucuggacuuacaacgcugagcuccuugugcuguuggaaaaugagcgaacccuagacuaucacgauagcaacgugaaaaaucuguacgagaagguuagaucacagcucaaaaacaacgccaaggaaaucggcaauggauguuuugaguucuaucauaagugcgacaacacauguauggaaagugugaaaaauggcacuuacgauuauccuaaguacuccgaggaagcaaaacugaacagggaggagauugacggggucaaacuugaaagcacccggaucuaucaaauucuggccauauacucuacaguggcuucaaguuugguccucgugguuagccugggagcgaucuccuuuuggaugugcucuaaugguucguuacagugccguauuuguaucuga

SEQ ID NO: 127501 - RNA, 1701 nt, Artificial Sequence; identical to SEQ ID NO: 127286
  derived and/or modified sequence opt3 from hemagglutinin__InfluenzaA__ADL32554

SEQ ID NO: 127502 - RNA, 1701 nt, Artificial Sequence; identical to SEQ ID NO: 126298
  derived and/or modified sequence opt3 from hemagglutinin__InfluenzaA__ADL32670

SEQ ID NO: 127503 - RNA, 1701 nt, Artificial Sequence
  derived and/or modified sequence opt3 from hemagglutinin__InfluenzaA__ADL32690
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauguggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccccgaaaggcgcuaucaacacgucccuacccuuccagaauauucacccuaucacuaucgguaagugcccaaaguauguaaaaucaacaaagcuccgccuggccaccgggcuuagaaacgugcccaguauucagagcaggggacuguuuggcgcgauagccggcuucaucgaagggggauggacugguauggucgacggcugguacggguaucaucaccagaaugaacaaggauccggcuacgcagcugauuugaaaucuacacagaacgccauugacgagaucaccaauaaggugaacagcguuauagagaaaaugaauacgcaguuuaccgcuguggguaaggaguucaaccaccucgagaagcggauugaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacucaauagagaggagauugacggggucaagcuggaaucuacuaggaucuaucaaauucuugcuauauacucaaccguggcgaguagccuggucuuggugguuucccucggagcaaucucuuuuuggaugugcucgaacgguagccugcagugccggauuuguaucuga

SEQ ID NO: 127504 - RNA, 1701 nt, Artificial Sequence; identical to SEQ ID NO: 124865
  derived and/or modified sequence opt3 from hemagglutinin__InfluenzaA__ADL32710

SEQ ID NO: 127505 - RNA, 1701 nt, Artificial Sequence; identical to SEQ ID NO: 124685
  derived and/or modified sequence opt3 from hemagglutinin__InfluenzaA__ADL32720

SEQ ID NO: 127506 - RNA, 1701 nt, Artificial Sequence; identical to SEQ ID NO: 126457
  derived and/or modified sequence opt3 from hemagglutinin__InfluenzaA__ADL32730

SEQ ID NO: 127507 - RNA, 1701 nt, Artificial Sequence; identical to SEQ ID NO: 126457
  derived and/or modified sequence opt3 from hemagglutinin__InfluenzaA__ADL32740

SEQ ID NO: 127508 - RNA, 1701 nt, Artificial Sequence; identical to SEQ ID NO: 125629
  derived and/or modified sequence opt3 from hemagglutinin__InfluenzaA__ADL39137

SEQ ID NO: 127509 - RNA, 1698 nt, Artificial Sequence
  derived and/or modified sequence opt3 from hemagglutinin__InfluenzaA__ADL39148
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcgauuuuggcuccgggaucauaaauagcaacgcgcccauggacaagugugaugcaaaaugccagaccccucaaggagccauuaauucgucucugccauuccagaacgugcaccccguaacaaucggcgaguguccuaaguaugugagauccgcuaaauuaaggauggucaccggucugcggaauauuccaucaauccagagucgcgggcucuuuggagccaucgcaggcuucauugaaggcggguggacgggaaugguggacgguugguacggcuaucaucaccagaacgagcaagggagcggauacgcugccgaucagaaguccacucagaaugcgauaaacggcaucacaaauaaaguuaacucugugauugaaaagaugaauacccaguuuacugccgucgguaaggaguucaacaaacuugagcgaagaauggaaaaccugaauaagaaaguggacgauggguucaucgacauauggacauacaacgcagaguugcuaguacugcucgaaaaugagaggacccuggacuuucacgauagcaacguuaagaaucuuuaugaaaaagugaagucacaacugaagaacaaugcuaaagagauuggcaacggaugcuucgaguuuuaccauaaguguaaugacgaaugcauggagagugucaaaaacggcacguaugauuaccccaaguauuccgaagagagcaaauugaaucgggagaagaucgacggggugaagcucgaaucuaugggagucuaccagauccuggccauuuauucaaccguggcuaguagcuuaguucugcuagugucccucggugccaucucuuucuggaugugcucgaacggcagccugcagugucguauuugcauauga

SEQ ID NO: 127510 - RNA, 1701 nt, Artificial Sequence
  derived and/or modified sequence opt3 from hemagglutinin__InfluenzaA__ADL39159
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagaucauagauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauucggcgcuccaacaauucauuuuucagucgacugaacuggcugacucaucucaaguuuaaguauccagcauuaaaugugaccaugcccaacaacgagcaguucgacaaacuguacaucuggggaguccaccauccuggcacagauaaugaccagauuuuucuuuaugcccaagcuagcggccguaucacugugucuaccaagagaucccagcagacaguaauaccaaacauugggucaaggccccggguucgcaauaucccuagcagaauuaguaucuacuggaccaucgugaaaccaggagauauuuugcugauaaacucuacggguaaucuaaucgccccgaggggcuacuucaagauucgguccgggaaaagcucgaucaugcgcucugacgcgcccauaggaaaguguaacuccgaaugcauuacuccuaauggcucaaucccaaacgacaagcccuuucagaaugucaaccgaaucacauauggugcauguccuagauacgugaaacaaaauacccucaagcuggccacugggaugaggaacgugccagagaaacagacacggggaauuuucggcgcuaucgccggcuuuauugaaaaugggugggagggaauggucgaugguugguauggcuuccgucaccagaacagugaggggcgcggacaagcagcugaccuuaagagcacccaggccgcgauagaucagaucaauggcaaacugaacagauugauugguaagacgaacgaaaaauuccaccagaucgagaaggaauuuuccgagguugaagggaggauccaagaccucgagaaguacguggaggauaccaaaauugaccuguggucuuauaaugccgaauuacugguagcacucgagaaccagcauacaauagaucuuacugacagcgaaaugaauaagcuguucgagaaaaccaagaaacaguugcgggaaaacgcugaggauaugggcaauggaugcuuuaagaucuaccacaagugugacaacgccugcauucgaucaauccgcaauggcacauaugaucaugacguguacagagacgaggcucuaaacaauagguuccagauuaaaggggucgaacugaagaguggauacaaagauuggauccucuggauauccuuugccaucagcugcuuccugcuuuguuuugcacuguuggguuucauuaugugggccugccaaaagggcaacauccgguguaauauuugcaucuga

SEQ ID NO: 127511 - RNA, 1701 nt, Artificial Sequence
  derived and/or modified sequence opt3 from hemagglutinin__InfluenzaA__ADL39170
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccguccccaacaacgagcaguucgacaagcuguacauuuggggagugcaccauccuggcacagauaaagaccagaucuuuuuguaugcccaagcuagcggccguauuacuguaucuaccaagagaucccagcagacaguuaucccaaauauagggucaaggccccgggugcgcaacauuccuagcagaaucaguauuuacuggaccaucgucaaaccaggagaugugcugcuaaucaauucuacggguaaccucauugccccgaggggcuacuucaagauacgguccggaaagagcucgaucaugcgcucugacgcgcccauugggaaauguaauuccgagugcaucacuccuaacggcucaauaccaaaugacaagcccuuucagaacgugaaucgaauuacauauggugcauguccuagauacgucaaacaaaacacccugaaacuugccacugggaugaggaauguuccagaaaaacagacacggggaaucuucggcgcuaucgccggcuuuauugagaacgggugggaaggaaugguggaugguugguauggcuuccgucaccagaauagugaggggcgcggacaagcagcugaccuuaagagcacccaggccgcgaucgaucagauuaacggcaaauugaauagacucauagguaagacgaacgagaaguuccaccagaucgaaaaagaguuuuccgaaguagaggggaggauucaagaccuggaaaaguacguggaggauaccaaaaucgacuuauggucuuauaacgccgagcugcucgucgcacuugaaaaucagcauacaaucgaucugacugacagcgagaugaacaaguuguucgaaaagaccaagaagcagcuacgggagaaugcugaagauaugggcaacggaugcuuuaaaauuuaccacaagugugacaaugccugcauaggcucaauccgaaacgggacauaugaucaugacguguaccgcgacgaggcucugaauaacagauuccagauuaaaggaguugagcucaagagugguuacaaagauuggauccuguggauuuccuuugccaucagcugcuuccuucuguguguggcauugcucggcuuuauaaugugggccugccaaaaggggaauaucagguguaacauuugcaucuga

SEQ ID NO: 127512 - RNA, 1701 nt, Artificial Sequence; identical to SEQ ID NO: 125629
  derived and/or modified sequence opt3 from hemagglutinin__InfluenzaA__ADL39203

SEQ ID NO: 127513 - RNA, 1701 nt, Artificial Sequence; identical to SEQ ID NO: 124450
  derived and/or modified sequence opt3 from hemagglutinin__InfluenzaA__ADL39214

SEQ ID NO: 127514 - RNA, 1698 nt, Artificial Sequence
  derived and/or modified sequence opt3 from hemagglutinin__InfluenzaA__ADL39225
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggcuacuuugcugauuaugaggaacugagagagcaacucucuucggugagcucauucgaaagguuugagauuuucccuaaggagaguuccuggccaaaccauacugucacaggugccucugcaagcugcucccacaauggggaaaacucauuuuaccggaauuuacuguggcuuaccggaaagaacggcuuguaucccaaucugaguaagagcuacgccaacaacaaagagaaggaagugcuaguacucuggggcguucaucacccuccaaauaucgcugaccagaaaacgcuguaccacacugagaacgcauaugugucugucguguccucacauuacagccgcaaguucacccccgaaauagccaagcgaccuaaagugcgugaucaggaggggagaaucaauuauuacuggacacuucuggagccaggagacacuauuaucuuugaagcuaacgguaauuugauugccccgagguaugcguucgcacucagucggggcuuugggucuggaaucauaaacuccaaugcccccauggauaagugugacgcuaaaugccagaccccucaaggcgccauuaacagcucgcugccauuccagaauguccaccccguuacaaucggugaguguccuaaguacgugcgcucugcaaaauuaagaaugguaaccgggcugaggaacauuccauccauccagucacggggacucuuuggcgcuaucgccggcuucauugaagggggauggacggguaugguggauggcugguauggguaccaucaccagaaugagcaaggaaguggcuacgcggccgaccagaaaagcacucagaacgcaauaaaugguaucacaaacaaagucaauuccgugauugaaaagaugaacacccaguuuacugcuguugggaaggaguucaacaaacuugagcgccgaauggaaaaucugaacaagaaaguggaugacggcuucaucgauauauggacauauaaugccgaguugcuaguccugcucgaaaacgagagaacccuggacuuucacgacucuaaugugaagaaccuuuacgaaaaaguaaagagccaacugaagaauaacgcuaaagagauuggaaauggcugcuucgaguuuuaucauaaguguaacgaugaaugcauggagucaguuaaaaaugggacguacgacuaucccaaguacagugaagaguccaaauugaacagggagaagaucgauggagugaagcucgaaagcaugggugucuaucagauccuggccauuuacucuaccguggcaucaaguuuaguccugcuagugagccucggcgccaucuccuucuggaugugcucuaaugggucgcugcagugucggauuugcauauga

SEQ ID NO: 127515 - RNA, 1698 nt, Artificial Sequence
  derived and/or modified sequence opt3 from hemagglutinin__InfluenzaA__ADL39236
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggcuacuuugcugauuaugaggaacugagagagcaacucucuucggugagcucauucgaaagguuugagauuuucccuaaggagaguuccuggccaaaccauacugucacaggugugucugccagcugcucccacaauggggaaucaaguuuuuaccggaacuuacuguggcuuaccggcaaaaauggauuguaucccaaccugagcaagucuuacacgaauaacaaagagaaggaaguucuaguacucuggggcgugcaucacccuccaaacaucgucgaccagaaaacucuguaccgcaccgagaaugcauauguguccguggucucaagccacuacagucgaaaguucacacccgaaauagccaagcguccuaaaguuagagaucaggaggggaggaucaacuauuacuggacucuucuggagccaggagacaccauuaucuuugaagcuaaugguaacuugauugcaccgcgguaugccuucgcucucucucgcggcuuuggguccggaaucauaaauagcaacgcccccaugggcaagugugaugcgaaaugccagacaccucaaggugcaauuaauucgucucugccauuccagaacgugcaucccguaaccaucggggaguguccuaaguacgugagauccgccaaauuaaggauggucacgggacugcggaauauuccaucaauccagagucgcggccucuuuggcgcuaucgccggguucauugaaggagguuggacuggcaugguggacgggugguauggauaccaccaucagaacgagcaaggcagcgguuacgcagcugaucagaaguccacacagaaugccauaaacgggaucaccaauaaaguuaacucugugauugaaaagaugaauacucaguuuacagcggucggcaaggaguucaacaaacuugagcgaagaauggaaaaccugaauaagaaaguggacgauggauucaucgacauauggaccuauaacgccgaguugcuaguacugcucgaaaaugagaggacgcuggauuuucacgacagcaacguuaagaaucuuuacgaaaaagugaagucacaacugaagaacaaugcaaaagagauuggcaacgggugcuucgaguuuuaucacaaguguaaugacgaaugcauggagagugucaaaaacggaaccuacgauuaucccaaguacuccgaagagagcaaauugaaucgggagaagaucgacggugugaagcucgaaucuaugggcgucuaucagauccuggcuauuuacucaacaguggccaguagcuuaguucugcuagugucccucggggcuaucucuuucuggaugugcucgaacggaagccugcagugucguauuugcauauga

SEQ ID NO: 127516 - RNA, 1701 nt, Artificial Sequence
  derived and/or modified sequence opt3 from hemagglutinin__InfluenzaA__ADL39280
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuacguuuuaaguauccagcacugaaugugaccaugcccaacaacgagcaguucgacaaacuuuacauuuggggaguccaccauccuggcacagauaaugaccagaucuuuuuguaugcccaagcuagcggcagaauuacugugucuaccaagaggucccagcagacaguaaucccaaacauagggucacggccccgcguuagaaauauuccuagcaggaucaguauuuacuggaccaucgugaagccaggagauauccugcuaauuaacucuacggguaaucucauagccccgcggggcuacuucaaaauccgcuccggaaagagcucgauuaugcgaucugacgcgcccaucgggaaauguaacuccgaaugcauaacuccuaauggcucaauuccaaacgacaagcccuuucagaaugucaacagaaucacauauggugcauguccuagguacgugaagcaaaauacccugaaacuugccacugggaugcggaacgugccagagaagcagacacguggaaucuucggcgcuauugccggcuuuaucgaaaaugggugggagggaauggucgaugguugguauggcuuccgccaccagaacagugaggggagaggacaagcagcugaccugaaaagcacccaggccgcgauugaucagauaaauggcaaguugaacaggcucaucgguaaaacgaacgaaaaguuccaccagauugagaaagaauuuuccgagguugaagggcggauccaagaccuggagaaguacguggaggauaccaagaucgacuuauggucuuauaaugccgaacugcucguagcacuugagaaccagcauacaauugaucugacugacagcgaaaugaauaaauuguucgagaagaccaaaaagcagcuacgagaaaacgcugaggauaugggcaauggaugcuuuaaaauauaccacaagugugacaacgccugcaucggcucaauucgcaaugggacauaugaucaugacguguacagagacgaggcucugaacaauagguuccagaucaagggagucgaacucaaaagugguuacaaggauuggauucuguggaucuccuuugccauaagcugcuuccuucuguguguggcauugcucggcuuuaucaugugggccugccaaaaagggaacauucgguguaauaucugcauuuga

SEQ ID NO: 127517 - RNA, 1698 nt, Artificial Sequence
  derived and/or modified sequence opt3 from hemagglutinin__InfluenzaA__ADL39291
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggagguucuaguacucuggggcgugcaccacccuccaaacaugggcgaccagaaaacgcuguaccauacugaaaaugccuacgucuccguggugucaagccacuauagucgcaaguucacccccgagaucgcuaagcgaccuaaaguccgugaucaggaggggagaauaaacuacuauuggacacuucuggaaccaggagacacuaucauuuuugaggcaaaugguaacuugaucgccccgagguacgcuuucgcccucucucggggcuuuggguccggaauuaucaauagcaacgcgcccauggauaagugugacgcaaaaugccagaccccucaaggcgccauaaauucgucucugccauuccagaacguucaucccgugacaauuggugaauguccuaaguauguacgcuccgcuaaauuaagaauggugaccgggcugaggaauaucccaucaauucagagucggggacucuuuggcgccaucgcaggcuucaucgaagggggauggacggguauggucgauggcugguacggguaucaccaccagaacgagcaaggaagcggcuacgcugccgaccagaaguccacucagaaugcgauuaacgguauaacaaauaaagugaacucuguuaucgagaagaugaauacccaguuuacugccguggggaaggaguucaacaaacuugaacgccgaauggagaaccugaauaagaaagucgaugacggcuucauugauaucuggacauacaacgcagaauugcuagugcugcucgagaaugaaagaacccuggacuuucaugacagcaacguaaagaaucuuuaugagaaaguuaagucacaacugaagaacaaugcuaaagagauaggaaacggcugcuucgaauuuuaccacaaguguaaugaugagugcauggaaagugugaaaaacgggacguaugacuaccccaaguauuccgaggagagcaaauugaauagggaaaagauugauggagucaagcucgagucuauggguguguaccagauccuggccaucuauucaaccgucgcuaguagcuuagugcugcuaguuucccucggcgccauuucuuucuggaugugcucgaacgggagccugcagugucggaucugcauuuga

SEQ ID NO: 127518 - RNA, 1701 nt, Artificial Sequence; identical to SEQ ID NO: 124450
  derived and/or modified sequence opt3 from hemagglutinin__InfluenzaA__ADL39302

SEQ ID NO: 127519 - RNA, 1701 nt, Artificial Sequence; identical to SEQ ID NO: 127516
  derived and/or modified sequence opt3 from hemagglutinin__InfluenzaA__ADL39313

SEQ ID NO: 127520 - RNA, 1701 nt, Artificial Sequence
  derived and/or modified sequence opt3 from hemagglutinin__InfluenzaA__ADL39335
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuacguuuuaaguauccagcacugaaugugaccaugcccaacaacgagcaguucgacaaacuuuacauuuggggaguccaccauccuggcacagauaaugaccagaucuuuuuguaugcccaagcuagcggcagaauuacugugucuaccaagaggucccagcagacaguaaucccaaacauagggucacggccccgcguuagaaauauuccuagcaggaucaguauuuacuggaccaucgugaagccaggagauauccugcuaauuaacucuacggguaaucucauagccccgcggggcuacuucaaaauccgcuccggaaagagcucgauuaugcgaucugacgcgcccaucgggaaauguaacuccgaaugcauaacuccuaauggcucaauuccaaacgacaagcccuuucagaaugucaacagaaucacauauggugcauguccuagguacgugaagcaaaauacccugaaacuugccacugggaugcggaacgugccagagaagcagacacguggaaucuucggcgcuauugccggcuuuaucgaaaaugggugggagggaauggucgaugguugguauggcuuccgccaccagaacagugaggggagaggacaagcagcugaccugaaaagcacccaggccgcgauugaucagauaaauggcaaguugaacaggcucaucgguaaaacgaacgaaaaguuccaccagauugagaaagaauuuuccgagguugaagggcggauccaagaccuggagaaguacguggaggauaccaagaucgacuuauggucuuauaaugccgaacugcucguagcacuugagaaccagcauacaauucaccugacugauagcgaaaugaauaaauuguucgagaagaccaaaaagcagcuacgagaaaacgcugaggacaugggcaauggaugcuuuaaaauauaccauaagugugauaacgccugcaucggcucaauucgcaaugggacauaugaccacgauguguacagagacgaggcucugaacaauagguuccagaucaagggagucgaacucaaaagugguuacaaggacuggauucuguggaucuccuuugccauaagcugcuuccuucuguguguggcauugcucggcuuuaucaugugggccugccaaaaagggaacauucgguguaauaucugcauuuga

SEQ ID NO: 127521 - RNA, 1701 nt, Artificial Sequence; identical to SEQ ID NO: 124450
  derived and/or modified sequence opt3 from hemagglutinin__InfluenzaA__ADL39368

SEQ ID NO: 127522 - RNA, 1698 nt, Artificial Sequence
  derived and/or modified sequence opt3 from hemagglutinin__InfluenzaA__ADL39390
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccagccugucuaaguccuaugcaaacaauaaagagaaggaaguucuaguacucuggggcgugcaccacccuccaaacaucgucgaccagaaaacgcuguaccgcacugagaacgccuacgugucaguggucagcagucauuauucucgaaaguucacccccgaaauagcuaagcguccuaaaguuagagaucaggaggggaggaucaauuacuauuggacacuucuggagccaggagacacuauuaucuuugaagcaaacgguaauuugauugccccgcgguacgcuuucgcccucucccgcggcuuugggagcggaaucauaaacucgaaugcgcccaugggcaagugugaugcaaaaugccagaccccucaaggugccauuaacucuucccugccauuccagaaugugcaccccguaacaaucggggaguguccuaaguaugugagaucagcuaaauuaaggauggucaccggacugcggaacauuccaaguauccagagccgcggccucuuuggcgccaucgcaggguucauugaaggagguuggacgggcaugguggacgggugguacggauaucaucaccagaaugagcaaggcuccgguuacgcugccgaucagaagucuacucagaacgcgauaaaugggaucacaaacaaaguuaauagcgugauugaaaagaugaacacccaguuuacugccgucggcaaggaguucaauaaacuugagcgaagaauggaaaaccugaacaagaaaguggacgauggauucaucgacauauggacauacaaugcagaguugcuaguacugcucgaaaacgagaggacccuggauuuucacgacucaaauguuaagaaccuuuaugaaaaagugaagagucaacugaagaauaacgcuaaagagauuggcaaugggugcuucgaguuuuaccauaaguguaacgacgaaugcauggaguccgucaaaaauggaacguaugauuaccccaaguauagcgaagagucuaaauugaaccgggagaagaucgacggugugaagcucgaaucaaugggcgucuaccagauccuggccauuuauaguaccguggcuagcuccuuaguucugcuagugucucucggggccaucucguucuggaugugcagcaauggaucccugcagugucguauuugcauauga

SEQ ID NO: 127523 - RNA, 1701 nt, Artificial Sequence
  derived and/or modified sequence opt3 from hemagglutinin__InfluenzaA__ADL39401
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcaugcggcgcucaaacaauagcuuuuucagucgacugaacuggcucacucauuuaaaguuuaaguauccagcucugaaugugaccaugcccaacaacgagcaguucgacaaacuuuacaucuggggaguccaccauccuggcacagauaaugaccagauuuuucuuuaugcacaagccucuggccguaucacuguguccaccaagagaucacagcagacaguaauuccaaacaucgggagcaggccccggguucgcaauauaccuaguagaauuucuaucuacuggaccauugugaaaccaggagauauccugcuaaucaacuccacggguaaucucauugcuccgaggggcuacuucaagauacggagcgggaaaucgucuaucaugcgcuccgacgcccccauuggaaaguguaacucagaaugcaucacuccuaauggcaguauaccaaacgacaagcccuuucagaaugucaaccgaauuacauauggugcguguccuagauacgugaaacaaaauacccugaaguuggcaacugggaugaggaacgugccagagaaacagacacggggaaucuucggcgccaucgcuggcuuuauugaaaaugggugggagggaauggucgaugguugguauggcuuccgucaccagaacagcgaggggcgcggacaagccgcagaccugaaguccacccaggcugccaucgaucagauuaauggcaaauugaacagacucauagguaagacgaacgaaaaauuccaccagaucgagaaggaauuuucugagguugaagggaggauucaagaccuggagaaguacguggaggauaccaaaaucgacuuauggagcuauaaugcggaacugcucguagcccuugagaaccagcauacaaucgaucugacugacucagaaaugaauaaguuguucgagaaaaccaagaaacagcuacgggaaaacgcagaggauaugggcaauggaugcuuuaagauuuaccacaagugugacaacgcuugcauaggcaguauccgaaaugggacauaugaucaugacguguaccgcgacgaggcccugaacaauagauuccagauuaaaggagucgaacucaaguccgguuacaaagauuggauccuguggauuagcuuugcuaucucuugcuuccuucuguguguggccuugcucggcuuuauaaugugggcaugccaaaaggggaacaucagguguaauauuugcaucuga

SEQ ID NO: 127524 - RNA, 1701 nt, Artificial Sequence
  derived and/or modified sequence opt3 from hemagglutinin__InfluenzaA__ADL39412
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgaaaagagcucgauuaugcgcucugacgcgcccaucgggaaguguaacuccgagugcauaacuccuaauggaucaauuccaaacgacaagcccuuucagaaugucaaccgaaucacauauggcgcauguccuagauacgugaaacaaaauacccugaaacuugccacugguaugaggaacgugccagaaaaacagacacgggggaucuucggagcuauugccggcuuuaucgagaauggcugggaggggauggucgauggaugguaugguuuccgucaccagaacagugaaggccgcgggcaagcagcugaccugaaaagcacccaggccgcgauugaucagauaaauggaaaauugaacagacucaucggcaagacgaacgagaaauuccaccagauugaaaaggaguuuuccgaaguugaggguaggauccaagaccuggagaaguacguggaagauaccaaaaucgacuuauggucuuauaaugccgagcugcucguagcacuugaaaaccagcauacaauugaucugacugacagcgagaugaauaaguuguucgaaaagaccaagaaacagcuacgggagaacgcugaggauauggggaauggcugcuuuaagauauaccacaagugugacaacgccugcaucggaucaauucgaaauggcacauaugaucaugacguguaccgcgacgaagcucugaacaauagauuccagaucaaaggggucgagcucaagaguggauacaaagauuggauucuguggaucuccuuugccauaagcugcuuccuucuguguguggcauugcucgguuuuaucaugugggccugccaaaagggcaacauuagguguaauaucugcauuuga

SEQ ID NO: 127525 - RNA, 1698 nt, Artificial Sequence
  derived and/or modified sequence opt3 from hemagglutinin__InfluenzaA__ADL39423
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaucucacacugucacaggugugagcgccuccugcucacauaacggggaaaauaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgccgaccagaaaacgcuguaccauacugagaaugcuuacgucuccguggugucaagccacuauagucgcaaguucacccccgaaauagcaaagcgaccuaaaguccgugaucaggaggggagaaucaacuacuauuggacacuucuggagccaggagacacuauuaucuuugaagccaaugguaacuugauugcuccgagguacgccuucgcgcucucucggggcuuuggguccggaaucauaaauagcaacgcacccauggauaagugugacgccaaaugccagaccccucaaggcgcuauuaauucgucucugccauuccagaacguucaucccgugacaaucggugaguguccuaaguauguacgcuccgccaaauuaagaauggugaccgggcugaggaauauuccaucaauccagagucggggacucuuuggcgcaaucgcuggcuucauugaagggggauggacggguauggucgauggcugguacggguaucaccaccagaacgagcaaggaagcggcuacgccgcggaccagaaguccacucagaaugccauaaacgguaucacaaauaaagugaacucuguuauugaaaagaugaauacccaguuuacugcaguggggaaggaguucaacaaacuugagcgccgaauggaaaaccugaauaagaaagucgaugacggcuucaucgauauauggacauacaacgcugaguugcuagugcugcucgaaaaugagagaacccuggacuuucaugacagcaacguaaagaaucuuuaugaaaaaguuaagaaccaacugaagaauaacgccaaagagauuggaaauggcugcuucgaguuuuaccacaaguguaacgaugaaugcauggagucagugaaaaaugggacguaugacuaccccaaguauagugaagaguccaaauugaacagggagaagaucgauggagucaagcucgaaagcauggguguguaccagauccuggcuauuuauucuaccgucgccucaaguuuagugcugcuaguuagccucggcgcaaucuccuucuggaugugcucuaaugggucgcugcagugucggauuugcauauga

SEQ ID NO: 127526 - RNA, 1701 nt, Artificial Sequence
  derived and/or modified sequence opt3 from hemagglutinin__InfluenzaA__ADL39434
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuacguuuuaaguauccagcacugaaugugaccaugcccaacaacgagcaguucgacaaacuuuacauuuggggaguccaccauccuggcacagauaaugaccagaucuuuuuguaugcccaagcuagcggcagaauuacugugucuaccaagaggucccagcagacaguaaucccaaacauagggucacggccccgcguuagagauauuccuagcaggaucaguauuuacuggaccaucgugaagccaggagacauccugcuaauuaauucuacggguaaccucauagccccgcggggcuacuucaaaauccgcuccggaaagagcucgauuaugcgaucugacgcgcccaucgggaaauguaauuccgaaugcauaacuccuaacggcucaauuccaaaugauaagcccuuucagaacgucaauagaaucacauauggugcauguccuagguacgugaagcaaaacacccugaaacuugccacugggaugcggaaugugccagagaagcagacacguggaaucuucggcgcuauugccggcuuuaucgaaaacgggugggagggaauggucgacgguugguauggcuuccgccaccagaauagugaggggagaggacaagcagcugaucugaaaagcacccaggccgcgauugaccagauaaacggcaaguugaauaggcucaucgguaaaacgaacgaaaaguuccaccagauugagaaagaauuuuccgagguugaagggcggauccaagaucuggagaaguacguggaggacaccaagaucgauuuauggucuuauaacgccgaacugcucguagcacuugagaaucagcauacaauugaccugacugauagcgaaaugaacaaauuguucgagaagaccaaaaagcagcuacgagaaaaugcugaggacaugggcaacggaugcuuuaaaauauaccacaagugugauaaugccugcaucggcucaauucgcaacgggacauaugaccaugacguguacagagaugaggcucugaauaacagguuccagaucaagggagucgaacucaaaagugguuacaaggacuggauucuguggaucuccuuugccauaagcugcuuccuucuguguguggcauugcucggcuuuaucaugugggccugccaaaaagggaauauucgguguaacaucugcauuuga

SEQ ID NO: 127527 - RNA, 1698 nt, Artificial Sequence
  derived and/or modified sequence opt3 from hemagglutinin__InfluenzaA__ADL39445
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccacgcugagcaagucuuaugcaaacaauaaagagaaggaaguucuaguacucuggggcgugcaccacccuccaaacaucgucgaccagaaaacucuguaccgcaccgagaacgccuacguguccguggucucaagccauuauagucgaaaguucacacccgaaauagcuaagcguccuaaaguuagagaucaggaggggaggaucaauuacuauuggacucuucuggagccaggagacaccauuaucuuugaagcaaacgguaauuugauugccccgcgguacgcuuucgcccucucucgcggcuuuggguccggaaucauaaacagcaaugcgcccauggauaagugugacgcaaaaugccagacaccucaaggcgccauuaacucgucucugccauuccagaaugugcaccccguaaccaucggugaguguccuaaguaugugagauccgcuaaauuaaggauggucacggggcugcggaacauuccaucaauccagagucgcggacucuuuggcgccaucgcaggcuucauugaagggggauggacugguaugguggauggcugguacggguaucaucaccagaaugagcaaggaagcggcuacgcugccgaccagaaguccacacagaacgcgauaaaugguaucaccaacaaaguuaauucugugauugaaaagaugaacacucaguuuacagccgucgggaaggaguucaauaaacuugagcgaagaauggaaaaccugaacaagaaaguggaugacggcuucaucgauauauggaccuacaaugcagaguugcuaguacugcucgaaaacgagaggacgcuggacuuucacgacagcaauguuaagaaccuuuaugaaaaagugaagucacaacugaagaauaacgcuaaagagauuggaaauggcugcuucgaguuuuaccauaaguguaacgaugaaugcauggagagugucaaaaaugggaccuaugacuaccccaaguauuccgaagagagcaaauugaaccgggagaagaucgauggagugaagcucgaaucuaugggugucuaccagauccuggccauuuauucaacaguggcuaguagcuuaguucugcuagugucccucggcgccaucucuuucuggaugugcucgaaugggagccugcagugucguauuugcauauga

SEQ ID NO: 127528 - RNA, 1698 nt, Artificial Sequence
  derived and/or modified sequence opt3 from hemagglutinin__InfluenzaA__ADL39456
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaucucacacugucacaggugugagcgccuccugcucacauaacggggaaaauaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgccgaccagaaaacgcuguaccauacugagaaugcuuacgucuccguggugucaagccacuauagucgcaaguucacccccgaaauagcaaagcgaccuaaaguccgugaucaggaggggagaaucaacuacuauuggacacuucuggagccaggagacacuauuaucuuugaagccaaugguaacuugauugcuccgagguacgccuucgcgcucucucggggcuuuggguccggaaucauaaauagcaacgcacccauggauaagugugacgccaaaugccagaccccucaaggcgcuauuaauucgucucugccauuccagaacguucaucccgugacaaucggugaguguccuaaguauguacgcuccgccaaauuaagaauggugaccgggcugaggaauauuccaucaauccagagucggggacucuuuggcgcaaucgcuggcuucauugaagggggauggacggguauggucgauggcugguacggguaucaccaccagaacgagcaaggaagcggcuacgccgcggaccagaaguccacucagaaugccauaaacgguaucacaaauaaagugaacucuguuauugaaaagaugaauacccaguuuacugcaguggggaaggaguucaacaaacuugagcgccgaauggaaaaccugaauaagaaagucgaugacggcuucaucgauauauggacauacaacgcugaguugcuagugcugcucgaaaaugagagaacccuggacuuucaugacagcaacguaaagaaucuuuaugaaaaaguuaagucacaacugaagaacaaugccaaagagauuggaaacggcugcuucgaguuuuaccacaaguguaaugaugaaugcauggagagugugaaaaacgggacguaugacuaccccaaguauuccgaagagagcaaauugaauagggagaagaucgauggagucaagcucgaaucuauggguguguaccagauccuggcuauuuauucaaccgucgccaguagcuuagugcugcuaguuucccucggcgcaaucucuuucuggaugugcucgaacgggagccugcagugucggauuugcauauga

SEQ ID NO: 127529 - RNA, 1698 nt, Artificial Sequence
  derived and/or modified sequence opt3 from hemagglutinin__InfluenzaA__ADL39467
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccaugggcaagugugaugcaaaaugccagaccccucaaggugccauuaauucgucucugccauuccagaacgugcaccccguaacaaucggggaguguccuaaguaugugagauccgcuaaauuaaggauggucaccggacugcggaauauuccaucaauccagagucgcggccucuuuggcgccaucgcaggguucauugaaggagguuggacgggcaugguggacgggugguacggauaucaucaccagaacgagcaaggcagcgguuacgcugccgaucagaaguccacucagaaugcgauaaacgggaucacaaauaaaguuaacucugugauugaaaagaugaauacccaguuuacugccgucggcaaggaguucaacaaacuugagcgaagaauggaaaaccugaauaagaaaguggacgauggauucaucgacauauggacauacaacgcagaguugcuaguacugcucgaaaaugagaggacccuggauuuucacgacagcaacguuaagaaucuuuaugaaaaagugaagucacaacugaagaacaaugcuaaagagauuggcaacgggugcuucgaguuuuaccauaaguguaaugacgaaugcauggagagugucaaaaacggaacguaugauuaccccaaguauuccgaagagagcaaauugaaucgggagaagaucgacggugugaagcucgaaucuaugggcgucuaccagauccuggccauuuauucaaccguggcuaguagcuuaguucugcuagugucccucggggccaucucuuucuggaugugcucgaacggaagccugcagugucguauuugcauauga

SEQ ID NO: 127530 - RNA, 1701 nt, Artificial Sequence; identical to SEQ ID NO: 124685
  derived and/or modified sequence opt3 from hemagglutinin__InfluenzaA__ADL41164

SEQ ID NO: 127531 - RNA, 1701 nt, Artificial Sequence; identical to SEQ ID NO: 124778
  derived and/or modified sequence opt3 from hemagglutinin__InfluenzaA__ADL41173

SEQ ID NO: 127532 - RNA, 1698 nt, Artificial Sequence
  derived and/or modified sequence opt3 from hemagglutinin__InfluenzaA__ADL60242
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaaguucuaguacucuggggcgugcaccacccuccagacaucgggaaccagaaaacgcuguaccauacugagaaugccuacgucucugugguguccucacacuauagccgaaaguucacccccgaaauagcuaagcguccuaaagucagagaucaggagggaaggaucaacuacuauuggacacuucuggagccaggugacacuauuaucuuugaagcaaauggcaacuugauugccccgcgguacgcuuucgcccucagucgcggguuuggaucuggcaucauaaauuccaacgcgcccauggauaagugugacgcaaaaugccagaccccucaaggugccauuaauagcucgcugccauuccagaacguucaucccgugacaaucggggaguguccuaaguauguaagaucugcuaaauuaaggauggugaccggacugcggaauauuccauccauccagucacgcggccucuuuggcgccaucgcaggguucauugaaggagguuggacgggcauggucgaugggugguacggauaucaccaccagaacgagcaaggcagugguuacgcugccgaccagaaaagcacucagaaugcgauaaacgggaucacaaauaaagugaacuccguuauugaaaagaugaauacccaguuuacugccgugggcaaggaguucaacaaacuugagcgaagaauggaaaaccugaauaagaaagucgaugacggauucaucgauauauggacauacaacgcagaguugcuagugcugcucgaaaaugagaggacccuggacuuucaugacucuaacguaaagaaucuuuaugaaaaaguuaagagccaacugaagaacaaugcuaaagagauuggcaacgggugcuucgaguuuuaccacaaguguaaugaugaaugcauggagucagugaaaaacggaacguaugacuaccccaaguauagugaagaguccaaauugaaucgggagaagaucgauggugucaagcucgaaagcaugggcguguaccagauccuggccauuuauucuaccgucgcuucaaguuuagugcugcuaguuagccucggggccaucuccuucuggaugugcucuaacggaucgcugcagugucguauuugcauauga

SEQ ID NO: 127533 - RNA, 1698 nt, Artificial Sequence
  derived and/or modified sequence opt3 from hemagglutinin__InfluenzaA__ADL60253
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcggacuccugauuaguaaagaaagcugguccuacaucguugagaagccaaacccggaaaauggcaccuguuaucccgguuacuuugcugauuaugaggagcugagagaacaacucucuucggugagcucauucgagagguuugaaauuuucccuaaggagaguuccuggccaaaccauacugucacaggggugucugccagcugcucccacaauggagagucaaguuuuuaccggaacuuacuguggcuuaccggcaaaaauggcuuguaucccaaccugagcaagucuuacgcaaauaacaaagaaaaggaggugcuaguucucuggggagugcaucacccuccaaacaucgggaaucagaaagcccuguaccacacggaaaacgcuuaugucuccguggugucaagccauuacagucgcaaguucacucccgagauagcaaagcgaccuaaaguccgugaccaggaagguagaaucaauuauuacuggacccuucuggagccaggcgauacaauuaucuuugaggccaacgggaauuugauugcuccgagguaugccuucgcgcucucucggggauuuggcuccgguaucauaaacagcaaugcacccauggacaagugugaugccaaaugccagacuccucaaggggcuauuaacucgucucugccauuccagaauguucaccccgugaccaucggagaauguccuaaguacguacgcuccgccaaauuaagaauggugacaggccugaggaacauuccaucaauccagagucggggccucuuuggggcaaucgcuggauucauugaggguggcuggaccgggauggucgacggaugguauggcuaccaucaccagaaugaacaagguagcggguacgccgcggaucagaaguccacgcagaacgccauaaauggcaucacuaacaaaguaaauucuguuauugagaagaugaacacacaguuuaccgcagugggaaaggaguucaacaaacuugaacgccgaauggagaaucugaacaagaaagucgacgauggcuucaucgacauauggacuuauaaugcugaauugcuagugcugcucgagaacgaaagaacacuggauuuucacgacagcaauguaaagaaccuuuacgagaaaguuaagucacaacugaagaauaacgccaaagaaauugggaauggaugcuucgaguuuuaucauaaguguaacgacgagugcauggaaagugugaaaaaugguaccuacgauuaucccaaguacuccgaggaaagcaaauugaacagggagaagaucgacggcgucaagcucgagucuauggggguguaucagauccuggcuauuuacucaacggucgccaguagcuuagugcugcuaguuucccucggagcaaucucuuucuggaugugcucgaauggcagccugcagugucggauuugcauauga

SEQ ID NO: 127534 - RNA, 1698 nt, Artificial Sequence; identical to SEQ ID NO: 127532
  derived and/or modified sequence opt3 from hemagglutinin__InfluenzaA__ADL60264

SEQ ID NO: 127535 - RNA, 1698 nt, Artificial Sequence; identical to SEQ ID NO: 127532
  derived and/or modified sequence opt3 from hemagglutinin__InfluenzaA__ADL60275

SEQ ID NO: 127536 - RNA, 1698 nt, Artificial Sequence
  derived and/or modified sequence opt3 from hemagglutinin__InfluenzaA__ADL60286
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccauccaucucaaaccagaaaacgcuguaccauacugagaaugccuacgucagcguggugaguucucacuauucccgcaaguucacccccgaagucgcuaagcgaccuaaaguucgugaccaggaggggagaauaaacuacuauuggacacuucuggagccaggagauacuaucauuuuugaagcaaaugguaacuugaucgccccgagguacgcuuucgcccucagccggggcuuugggucgggaauuaucaauucuaacgcgcccauggacaagugugaugcaaaaugccagaccccucaaggcgccauaaauuccucacugccauuccagaacgugcaucccguaacaauuggugaguguccuaaguaugugcgcagugcuaaauuaagaauggucaccgggcugaggaauaucccaagcauucagucccggggacucuuuggcgccaucgcaggcuucaucgaagggggauggacggguaugguggacggcugguacggguaucaccaccagaacgagcaaggaucuggcuacgcugccgaucagaaaagcacucagaaugcgauuaacgguauaacaaauaaaguuaacucagugaucgaaaagaugaauacccaguuuacugccgucgggaaggaguucaacaaacuugagcgccgaauggaaaaccugaauaagaaaguggacgauggcuucauugacaucuggacauacaacgcagaguugcuaguacugcucgaaaaugagagaacccuggauuuucaugacaguaacguuaagaaucuuuaugaaaaagugaagucccaacugaagaacaaugcuaaagagauaggaaacggcugcuucgaguuuuaccacaaguguaaugacgaaugcauggagagcgucaaaaacgggacguaugauuaccccaaguauucugaagagucaaaauugaauagggagaagauugacggagugaagcucgaaaguaugggugucuaccagauccuggccaucuauagcaccguggcuuccucuuuaguucugcuagugucgcucggcgccauuagcuucuggaugugcuccaacgggucacugcagugucggaucugcauuuga

SEQ ID NO: 127537 - RNA, 1698 nt, Artificial Sequence
  derived and/or modified sequence opt3 from hemagglutinin__InfluenzaA__ADL60297
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuacccgcaaaaauggauuguaccccaaccugagcaagucuuaugcaaauaacaaagagaaggaaguucuaguacucuggggcgugcaccacccuccaaacaucggcgaccagaaaacgcuguaccauacugagaaugccuacgucuccguggugucaagccacuauagucgaaaguucacccccgaaauagcuaagcguccuaaagucagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacguucaucccgugacaaucggugaguguccuaaguauguaagauccgcuaaauuaaggauggugaccgggcugcggaauauuccaucaauccagagucgcggacucuuuggcgccaucgcaggcuucauugaagggggauggacggguauggucgauggcugguacggguaucaccaccagaacgagcaaggaagcggcuacgcugccgaccagaaguccacucagaaugcgauaaacgguaucacaaauaaagugaacucuguuauugaaaagaugaauacccaguuuacugccguggggaaggaguucaacaaacuugagcgaagaauggaaaaccugaauaagaaagucgaugacggcuucaucgauauauggacauacaacgcagaguugcuagugcugcucgaaaaugagaggacccuggacagccaugacucaaacguaaagaaucuuuaugaaaaaguuaagagucaacugaagaacaaugcuaaagagauuggaaacggcugcuuugaguucuaccacaaguguaaugaugaaugcauggaguccgugaaaaacgggacguaugacuaccccaaguauagcgaagagucuaaauugaaucgggagaagaucgauggagucaagcucgaaucaauggguguguaccagauccuggccauuuauaguaccgucgcuagcuccuuagugcugcuaguuucucucggcgccaucucguuuuggaugugcagcaacgggucccugcagugucguauuugcauauga

SEQ ID NO: 127538 - RNA, 1698 nt, Artificial Sequence
  derived and/or modified sequence opt3 from hemagglutinin__InfluenzaA__ADL60308
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacaggcaaaaauggauuguaccccaaccugagcaagucuuaugccaauaacaaagagaaggaaguucuaguacucuggggcgugcaccacccuccaaacaucgggguccagaaagcucuguaccauaccgagaaugcauacguguccguggucucaagccacuauagucgcaaguucacgcccgaaauagccaagcgaccuaaaguucgugaccaggagggaagaaucaacuacuauuggacucuucuggagccaggugauaccauuaucuuugaagcuaauggcaacuugauugccccgagguacgcguucgcacucucucggggguuuggauccggcaucauaaauagcaacgcccccauggacaagugugaugcuaaaugccagacaccucaaggugccauuaauucgucucugccauuccagaacgugcaucccguaacuaucggggaguguccuaaguaugugcgcuccgcaaaauuaagaauggucaccggacugaggaauauuccaucaauccagagucggggccucuuuggcgcuaucgccggguucauugaaggagguuggacaggcaugguggacgggugguacggauaucaccaccagaacgagcaaggcagcgguuacgcggccgaucagaaguccacccagaaugcaauaaacgggaucacgaauaaaguuaacucugugauugaaaagaugaauacucaguuuacagcugucggcaaggaguucaacaaacuugagcgccgaauggaaaaccugaauaagaaaguggacgauggauucaucgacauauggaccuacaacgccgaguugcuaguacugcucgaaaaugagagaacucuggauuuucaugacagcaacguuaagaaucuuuaugaaaaagugaagucacaacugaagaacaaugcuaaagagauuggcaacgggugcuucgaguuuuaccacaaguguaaugacgaaugcauggagagugucaaaaacggaacauaugauuaccccaaguauuccgaagagagcaaauugaauagggagaagaucgacggugugaagcucgaaucuaugggcgucuaccagauccuggccauuuauucaaccguggcaaguagcuuaguucugcuagugucccucggggccaucucuuucuggaugugcucgaacggaagccugcagugucggauuugcauauga

SEQ ID NO: 127539 - RNA, 1698 nt, Artificial Sequence
  derived and/or modified sequence opt3 from hemagglutinin__InfluenzaA__ADL60341
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgggguccagaaagcccuguaccauacggagauagcuuacguguccguggucucaagccacuauagucgcaaguucacucccgaaaucgcaaagcgaccuaaaguucgugaccaggagggaagaauuaauuacuauuggaccauccuugagccaggugauacaauuaucuuugaagccaacggcaaucugauagcuccgagguacgccuucgcguugucucggggguuuggauccggcauuaucaacagcaaugcacccauggacaagugugaugccaaaugccagacuccucaaggugcuauuaacucgucucucccauuccagaaugugcaucccguaaccaucggggaguguccuaaguaugugcgcuccgccaaacugagaauggucacaggauuaaggaacaucccaucaauucagagucggggccuguuuggcgcaauagcuggguucaucgaaggagguuggaccggcaugguggacgggugguacggauaucaccaccagaaugagcaaggcagcgguuacgccgcggaucagaaguccacgcagaacgccauuaaugggaucacuaacaaaguuaauucugugauagaaaagaugaacacacaguuuaccgcagucggcaaggaguucaauaaacucgagcgccgaauggaaaaccuuaacaagaaaguggacgauggauucauugacaucuggacuuacaaugcugagcuguugguacuacuggaaaacgagagaacacucgauuuucaugacagcaauguuaagaaccuguaugaaaaagugaagucacaacuuaagaauaacgccaaagagaucggcaaugggugcuucgaguuuuaccacaaguguaacgacgaaugcauggagagugucaaaaauggaaccuaugauuaccccaaguauuccgaagagagcaaacugaacagggagaagauugacggugugaaguuggaaucuaugggcgucuaccagauccucgcuauuuauucaacgguggccaguagccugguuuuacuggugucccuaggggcaauaucuuucuggaugugcucgaauggaagccuccagugucggaucugcauuuga

SEQ ID NO: 127540 - RNA, 1698 nt, Artificial Sequence
  derived and/or modified sequence opt3 from hemagglutinin__InfluenzaA__ADL60352
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugguuacgaggaacugagagagcaacucucuucggugagcagcuucgaaagguuugagauuuucccuaaggagaguuccuggccaaaccacacugucacaggggugucugccagcugcucccauaauggagaacggucauuuuaucgcaacuuacuguggcuuaccggcaaaaauggcuuguaccccaaccugaguaagagcuaugcaaauaacaaagagaaggaaguucuaguacucuggggagugcaccacccuccagauaucgggaaccagaaaacgcuguaccauacugagaaugccuacgucucugugguguccucacacuauagccgaaaguucacccccgaaauagcuaagcguccuaaagucagagaccaggaggguaggaucaacuacuauuggacacuucuggagccaggcgauacuauuaucuuugaagcaaaugggaacuugauugccccgcgguacgcuuucgcccucagucgcggauuuggcucugguaucauaaauuccaacgcgcccauggacaagugugaugcaaaaugccagaccccucaaggggccauuaauagcucgcugccauuccagaacguucaucccgugacaaucggagaguguccuaaguauguaagaucugcuaaauuaaggauggugaccggccugcggaauauuccauccauccagucacgcggccucuuuggggccaucgcaggauucauugaagguggcuggacggggauggucgacggaugguacggcuaucaccaccagaacgagcaagguaguggguacgcugccgaucagaagucaacucagaaugcgauaaacggcaucacaaauaaagugaacuccguuauugaaaagaugaauacccaguuuacugccgugggaaaggaguucaacaaacuugagcgaagaauggaaaaccugaauaagaaagucgacgauggcuucaucgacauauggacauacaacgcagaguugcuagugcugcucgaaaaugagaggacccuggauuuucaugacucuaacguaaagaaucuuuaugaaaaaguuaagagccaacugaagaacaaugcuaaagagauugggaacggaugcuucgaguuuuaccacaaguguaaugacgaaugcauggagucagugaaaaacgguacguaugauuaccccaaguauagugaagaguccaaauugaaucgggagaagaucgacggcgucaagcucgaaagcauggggguguaccagauccuggccauuuauucuaccgucgcuucaaguuuagugcugcuaguuagccucggagccaucuccuucuggaugugcucuaacggcucgcugcagugucguauuugcauauga

SEQ ID NO: 127541 - RNA, 1701 nt, Artificial Sequence
  derived and/or modified sequence opt3 from hemagglutinin__InfluenzaA__ADL60363
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugaucgccagcaguggcacucucgaguucaauaacgaauccuuuaauuggacaggugugacccagaacgggacgucuagcgcuugcauucggcgcuccaauaacucauucuuuagucgacugaauuggcugacucauagcaaauucaaguauccagcacucaacguuaccaugcccaacaaugagaacuuugacaaguuauacaucuggggagugcaccauccuggcacagauaaugaccagauuuuccuguaugcccaggcuucuggccguaucacuauauccaccaaaagaucacaacagacagucauuccaaacaucgggagcaggccccgggugcgcgauauuccuaguagaaucucuaucuacuggaccauuguaaagccaggagacauacuuuugaucaauuccacggguaaccugauugccccgaggggcuacuuuaaaauccggagcgggaagucgucuauaaugcgcuccgacgcgcccauuggaaaauguaauucagaaugcaucacuccuaacggcaguaucccaaaugauaagcccuuccagaacguuaaucgaauuacauauggugcauguccuagauacgugaagcagaacacccuaaaacucgccacugggaugaggaaugucccagagaagcaaacacggggaaucuuuggcgcuauugccggcuucauagaaaacgggugggagggaaugguggacgguugguauggcuuccgucaccagaauagcgagggggugggacaggcagcugaucugaaauccacccaagccgcgaucgaccagauuaacggcaaacuuaaccgccugaucgguaagacgaaugaaaaguuucaccagaucgagaaagaguucucugaagucgaagggaggauucaggauuuggagaaguacguugaggacaccaagauagaucucuggagcuauaacgccgaacuguuaguggcacuggagaaucaacauacaaucgaccucacugauucagaaaugaacaaacuuuuugagaagaccaaaaagcagcugagagaaaaugcugaggacaugggcaacggaugcuucaaaauuuaccacaagugugauaaugccugcaucggcaguauucggaacgggacauaugaccaugacguauaccgagaugaggcuuugaauaaccgcuuucagaucaagggaguggaacuaaaauccgguuacaaggacuggauacuguggaucagcuucgccauuucuugcuuucuccuguguaucgcacuucugggcuucauuaugugggccugccagaaagggaauaucagauguaacauaugcauuuga

SEQ ID NO: 127542 - RNA, 1698 nt, Artificial Sequence
  derived and/or modified sequence opt3 from hemagglutinin__InfluenzaA__ADL60374
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccaugacggggaaucaaguuuuuaucggaauuuacuguggcuuaccggcaaaaacggauuguaccccaaucugagcaagucuuaugcaaacaauaaagagaaggaaguucuaguacucuggggcgugcaccacccuccaaacaucggggaucagaaagcccuguaccauacggagaacgcuuacgucuccguggugucaagccacuauagucgcaaguucacucccgaaauagcaaagcgaccuaaaguccgugaccaggagggaagaaucaauuacuauuggacccuucuggagccaggugauacaauuaucuuugaagccaacggcaauuugauugcuccgagguacgccuucgcgcucucucggggguuuggauccggcaucauaaacagcaaugcacccauggacaagugugaugccaaaugccagacuccucaaggugcuauuaacucgucucugccauuccagaauguucaucccgugaccaucggggaguguccuaaguauguacgcuccgccaaauuaagaguggucacaggacugaggaacauuccaucaauccagagucggggccucuuuggcgcaaucgcuggguucauugaaggagguuggaccggcaugguggacgggugguacggauaucaccaccagaaugagcaaggcagcgguuacgccgcggaucagaaguccacgcagaacgccauaaaugggaucacuaacaaaguuaauucugugauugaaaagaugaacacacaguuuaccgcagucggcaaggaguucaauaaacuugagcgccgaauggaaaaccugaacaagaaaguggacgauggauucaucgacauauggacuuacaaugcugaguugcuaguacugcucgaaaacgagagaacacuggacuuucaugauagcaauguuaagaaccuuuaugaaaaagugaagucacaacugaagaauaacgccaaagagauuggcaaugggugcuucgaguuuuaccacaaguguaacgacgaaugcauggagagugucaaaaauggaaccuaugauuaccccaaguauuccgaagagagcaaauugaacagggagaagaucgacggugugaagcucgaaucuaugggcgucuaccagauccuggcuauuuauucaacgguggccaguagcuuaguucugcuagugucccucggggcaaucucuuucuggaugugcucgaauggaagccugcagugucggauuugcauauga

SEQ ID NO: 127543 - RNA, 1701 nt, Artificial Sequence
  derived and/or modified sequence opt3 from hemagglutinin__InfluenzaA__ADM07135
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127544 - RNA, 1701 nt, Artificial Sequence; identical to SEQ ID NO: 125170
  derived and/or modified sequence opt3 from hemagglutinin__InfluenzaA__ADM07144

SEQ ID NO: 127545 - RNA, 1701 nt, Artificial Sequence
  derived and/or modified sequence opt3 from hemagglutinin__InfluenzaA__ADM07154
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaucccccuacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggugcggaacgcaggguccggaaucauaauuagcgauaccccgguacacgacugcaauacaaccugucaaacgcccaaaggcgcuaucaacacuucgcucccuuuccagaauauucacccaaucacaaucgguaagugccccaaguaugugaaaucuaccaagcugcgccuugccacugggcugagaaacgucccuuccauucagucaaggggauuguuuggcgcgauagccggcuucaucgaagggggauggacagguaugguggacggcugguacggguaucaucaccagaaugagcaaggaaguggcuacgcagcugaucucaaaagcacccagaacgccauugacgaaaucacgaauaagguuaacuccgugauagagaaaaugaauacccaguuuacagcugucgguaaggaguucaaccaccuggaaaagcggauugagaauuuaaacaaaaagguggaugacggguuccuggauaucuggacuuacaaugccgaacuccuuguacuguuggagaacgaacgcacccuagacuaucaugauucuaauguuaaaaaccuguacgagaaggugcgaagccagcucaaaaacaaugcaaaggagaucggcaacggauguuuugaguucuaucacaagugcgacaauacauguauggagucagucaaaaacggcacuuacgauuauccaaaguacagugaagaggccaaacugaauagagaagagauugacggggugaaacuugaguccaccaggaucuaucaaauucuggcuauauacagcacagucgcgucuucauuggugcucguugugagucugggagcaaucagcuuuuggaugugcuccaacgguucuuuacagugccggauuuguaucuga

SEQ ID NO: 127546 - RNA, 1701 nt, Artificial Sequence; identical to SEQ ID NO: 125170
  derived and/or modified sequence opt3 from hemagglutinin__InfluenzaA__ADM07163

SEQ ID NO: 127547 - RNA, 1698 nt, Artificial Sequence; identical to SEQ ID NO: 127529
  derived and/or modified sequence opt3 from hemagglutinin__InfluenzaA__ADM07460

SEQ ID NO: 127548 - RNA, 1701 nt, Artificial Sequence
  derived and/or modified sequence opt3 from hemagglutinin__InfluenzaA__ADM07504
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccggaacgggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaagaccuggagaaguacguggaggauacgaaaaucgacuuaugguccuauaacgcagaacugcucguagcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuaugaucaugacguguaccgcgacgaggcccugaauaacagauuccagaucaaaggagucgaacucaagucagguuacaaagauuggauucuguggaucaguuuugcaauauccugcuuccuucuguguguggccuugcucggcuuuaucaugugggcuugccaaaaggggaauauuagguguaacaucugcauuuga

SEQ ID NO: 127549 - RNA, 1701 nt, Artificial Sequence
  derived and/or modified sequence opt3 from hemagglutinin__InfluenzaA__ADM12806
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaguacacugaaacuugcuaccgggaugaggaaugugccagagaagcagacucggggaaucuucggcgccauugcaggcuuuaucgaaaacgggugggagggaauggucgaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguugaagggaggauccaagaccuggagaaguacguggaggauacgaaaaucgacuuauggagcuauaacgcagaacugcucguagcucuugagaaucagcauaccauugaucugacagacucagaaaugaacaaguuguucgagaaaacuaagaaacagcuacgggaaaaugccgaggauaugggcaacggaugcuuuaccauauaccacaagugugacaaugcuugcaucggcaguauucgaaacgggacauaugaucauaauguguaccgcgacgaggcccugaacaauagauuccagaucaagggagucgaacucaaauccgguuacaaggacuggauucuguggaucagcuuugcaauaucuugcuuccuucuguguguggccuugcucggcuuuaucaugugggcuugccaaaaagggaacauuagguguaauaucugcauuuga

SEQ ID NO: 127550 - RNA, 1701 nt, Artificial Sequence; identical to SEQ ID NO: 127549
  derived and/or modified sequence opt3 from hemagglutinin__InfluenzaA__ADM12817

SEQ ID NO: 127551 - RNA, 1701 nt, Artificial Sequence; identical to SEQ ID NO: 127549
  derived and/or modified sequence opt3 from hemagglutinin__InfluenzaA__ADM12828

SEQ ID NO: 127552 - RNA, 1701 nt, Artificial Sequence; identical to SEQ ID NO: 127549
  derived and/or modified sequence opt3 from hemagglutinin__InfluenzaA__ADM12839

SEQ ID NO: 127553 - RNA, 1701 nt, Artificial Sequence
  derived and/or modified sequence opt3 from hemagglutinin__InfluenzaA__ADM12850
augaaggccaucauugcucugagcuacauacucugccuuguguucgcacagaaacugcccggcaacgacaauuccaccgccacauuguguuuagggcaccaugcggucccuaacggaacuaucguuaagacgauuaccaaugaucaaaucgaggugacaaacgcuacugaacugguacagucuucaaguaccggugagauuugcgacagcccacaccagauccuagauggcgaaaauuguacacucauagacgcccugcuuggggauccgcagugcgacggauuucaaaacaaaaagugggaucuguucguggagagauccaaagcauauucuaauuguuaccccuaugacgucccugauuacgccucguugaggucacucguggcuagcaguggcacccuggaauuuaacaaugaguccuucaacuggacugguguuacacagaaugggaccucuagcgcaugcauccggcgcuccaacaauucauuuuucagucgacugaacuggcucacgcauuuaaauuuuaaguauccagcccugaacgugacuaugcccaacaaugagcaguucgacaaacuuuacauuuggggaguccaccauccuggcaccgauaaggaccagaucuuuuuguaugcucaagccagcggccguauuacagugucuacuaagagaucccagcaggcgguaaucccaaacauagggucaaggccccggguucgcaauauuccuagcagaaucaguauuuacuggaccaucgugaaaccaggagauauccugcuaauuaacucuacagguaaucucauagcaccgaggggcuacuucaagauccgguccgggaaaagcucgauuaugcgcucugacgcccccaucggaaaguguaacuccgaaugcauaaccccuaauggcucaauuccaaacgacaagcccuuucagaaugucaaccgaaucacguauggugcuuguccuagauacgugaaacaaaguacucugaaacuugccacagggaugaggaaugugccagagaagcagacccggggaaucuucggcgcaauugcuggcuuuaucgaaaacgggugggagggaauggucgaugguugguauggcuuccgucaccagaauagcgaggggcgcggacaagccgcggaccugaaguccacucaggccgcaauugaucagauaaacggcaaauugaauagacucaucgguaagacaaacgaaaaauuccaccagauugagaaggaauuuucugagguugaagggaggauccaagaccuggagaaguacguggaggauaccaaaaucgacuuauggagcuauaacgcugaacugcucguagcccuugagaaucagcauacgauugaucugaccgacucagaaaugaacaaguuguucgagaaaacaaagaaacagcuacgggaaaaugcugaggauaugggcaacggaugcuuuacuauauaccacaagugugacaaugccugcaucggcaguauucgaaacgggaccuaugaucauaauguguaccgcgacgaggcacugaacaauagauuccagaucaagggagucgaacucaaauccgguuacaaggacuggauucuguggaucagcuuugccauaucuugcuuccuucuguguguggcuuugcucggcuuuaucaugugggcgugccaaaaagggaacauuagguguaauaucugcauuuga

SEQ ID NO: 127554 - RNA, 1701 nt, Artificial Sequence; identical to SEQ ID NO: 124685
  derived and/or modified sequence opt3 from hemagglutinin__InfluenzaA__ADM12861

SEQ ID NO: 127555 - RNA, 1701 nt, Artificial Sequence; identical to SEQ ID NO: 124685
  derived and/or modified sequence opt3 from hemagglutinin__InfluenzaA__ADM12871

SEQ ID NO: 127556 - RNA, 1701 nt, Artificial Sequence; identical to SEQ ID NO: 124685
  derived and/or modified sequence opt3 from hemagglutinin__InfluenzaA__ADM12881

SEQ ID NO: 127557 - RNA, 1701 nt, Artificial Sequence; identical to SEQ ID NO: 124685
  derived and/or modified sequence opt3 from hemagglutinin__InfluenzaA__ADM12891

SEQ ID NO: 127558 - RNA, 1701 nt, Artificial Sequence; identical to SEQ ID NO: 124685
  derived and/or modified sequence opt3 from hemagglutinin__InfluenzaA__ADM12901

SEQ ID NO: 127559 - RNA, 1701 nt, Artificial Sequence; identical to SEQ ID NO: 125787
  derived and/or modified sequence opt3 from hemagglutinin__InfluenzaA__ADM12911

SEQ ID NO: 127560 - RNA, 1701 nt, Artificial Sequence; identical to SEQ ID NO: 124685
  derived and/or modified sequence opt3 from hemagglutinin__InfluenzaA__ADM12921

SEQ ID NO: 127561 - RNA, 1701 nt, Artificial Sequence; identical to SEQ ID NO: 124685
  derived and/or modified sequence opt3 from hemagglutinin__InfluenzaA__ADM12931

SEQ ID NO: 127562 - RNA, 1701 nt, Artificial Sequence; identical to SEQ ID NO: 124685
  derived and/or modified sequence opt3 from hemagglutinin__InfluenzaA__ADM12941

SEQ ID NO: 127563 - RNA, 1701 nt, Artificial Sequence; identical to SEQ ID NO: 124685
  derived and/or modified sequence opt3 from hemagglutinin__InfluenzaA__ADM12951

SEQ ID NO: 127564 - RNA, 1701 nt, Artificial Sequence
  derived and/or modified sequence opt3 from hemagglutinin__InfluenzaA__ADM12961
augaaggccgugcuggucguucuccuuuacaccuucgcuacagcaaacgccgacacucugugcaucggcuaucacgcgaauaacagcacggauaccguggacacaguauuggagaaaaaugugacugucacccauuccgugaacauuuuagaagauaagcacaaugggaaacuguguaagcuaggagguguugcuccccuccaucugggcaaaugcaacauagccggguggauccuuggaaauccugagugugaaucucugucaacagcaaguagcugguccuacauuguggagaccucuucgucagacaacggcacuugcuauccaggugauuuuaucgacuacgaagaguugagagagcagcucagcagugucuccucuuucgaaagguuugagauuuucccgaagacaagcuccuggcccaaucacgauucaaacaagggggugaccgccgcuuguccucaugcaggagccaaaaguuuuuauaagaaucugaucuggcugguuaaaaagggcaacagcuacccaaaacucucuaaguccuauauaaaugacaagggcaaagaaguauuagugcugugggggauccaccaccccucaacgagcgcugaucaacagagucuuuaccagaacgccgacgcguacgucuucgugggaacuucucgguauuccaagaaauuuaagccugagauugcaauccgcccaaaagugcgagaucaggagggucguaugaauuacuauuggaccuuggucgaacccggcgacaagauuacauucgaggccacugggaaccugguugugccuagauacgcuuuugccauggaaaggaacgcaggaagcggcaucauaauuucggauaccccaguacaugacugcaauacaaccugucaaacgccgaaaggugcuaucaacacuucucuacccuuccagaauauucacccuaucacaaucgggaagugcccaaaguaugugaaauccaccaagcuccggcuggccacuggacuucgcaacguccccucaauucagaguagaggccuguuuggcgcgauagccggguucaucgagggagguuggacaggcaugguggacgggugguacggauaucaucaccagaaugaacaaggcagcgguuacgcagcugauuugaaauccacccagaacgccauugacgagaucacgaauaagguuaacucugugauagagaaaaugaauacccaguuuacagcugucgggaaggaguucaaccaccucgaaaagaggauugaaaaucugaacaaaaagguggaugacggcuucuuagauaucuggacuuacaaugccgagcugcucguacuucuggaaaacgagcggaccuuggacuaucaugauagcaauguuaaaaaccuauacgagaaggugcgcucacagcugaaaaacaaugcaaaggaaaucggaaacggcuguuuugaguucuaucacaagugcgacaauacauguauggaaagugucaaaaacgggacuuacgauuauccuaaguacuccgaggaagccaaacucaaucgagaggagauugacggagugaagcuggaaagcaccagaaucuaucaaauucuugcuauauacucuacagucgcgucaagucugguguugguugugagccucggugcaaucuccuuuuggaugugcucuaacggcucgcugcagugcaggauuuguaucuga

SEQ ID NO: 127565 - RNA, 1701 nt, Artificial Sequence; identical to SEQ ID NO: 126334
  derived and/or modified sequence opt3 from hemagglutinin__InfluenzaA__ADM12971

SEQ ID NO: 127566 - RNA, 1701 nt, Artificial Sequence; identical to SEQ ID NO: 125786
  derived and/or modified sequence opt3 from hemagglutinin__InfluenzaA__ADM12981

SEQ ID NO: 127567 - RNA, 1701 nt, Artificial Sequence
  derived and/or modified sequence opt3 from hemagglutinin__InfluenzaA__ADM12991
augaaggccauccuggugguccuccuuuacaccuucgagacagcuaacgcagacacucugugcauuggcuaucacgccaauaacagcacggauaccguugacacaguguuggagaaaaauguaacugugacccauuccgucaacuuacuggaagauaagcacaaugggaaacuauguaagcucagaggaguggcgccccugcaucuugguaaaugcaacauagcuggcuggauccuggggaauccugaaugugagucuuugucaacagccaguagcugguccuacauuguugaaaccucuucgucagacaacggaacuugcuauccaggcgauuuuaucgacuacgaggagcucagggaacagcugagcaguguguccucuuucgagcgguuugaaauuuucccgaagacaagcuccuggcccaaucacgauucaaacaagggugucaccgcagccuguccucaugcuggggcaaaaaguuuuuauaagaaucugaucuggcucgugaaaaagggaaacagcuacccaaaauuaucuaaguccuauauaaaugacaagggcaaagagguacugguucuuuggggcauccaccaccccucaacgagcgccgaucaacagaguuuguaccagaacgcugacgccuacguguucgucgggacuucucgcuauuccaagaaauuuaagccugagauugcgauccgaccaaaagugcgugaucaggaaggaagaaugaauuacuauuggacccugguggagcccggugacaagauuacauucgaagcaacuggcaaccuagucguuccuagguacgccuuugcuauggagcggaacgccgggagcggaaucauaauuucggauaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgacggcugguacggguaucaucaccagaaugagcaaggaagcggcuacgccgcagaucucaaauccacccagcacgcuauugacgagaucacgaacaagguaaauucuguuauagaaaagaugaacacccaguuuacagccguggguaaggaguucaaucaucuggaaaagcggauugagaacuuaaauaaaaaggucgaugacggguuccuggauaucuggacuuacaacgcugaacuccuugugcuguuggagaaugagcgcacccuagacuaucacgauagcaacgugaaaaaucuguacgaaaagguucgaucacagcucaaaaacaacgccaaggagaucggcaauggauguuuugaguucuaucauaagugcgacaacacauguauggaaagugugaaaaauggcacuuacgauuauccuaaguacuccgaagaggcaaaacugaacagagaggaaauugacggggucaaacuugagagcaccaggaucuaucaaauucuggccauauacucuacaguggcuucaaguuugguccucgugguuagccugggagcgaucuccuuuuggaugugcucuaaugguucguuacagugccggauuuguaucuga

SEQ ID NO: 127568 - RNA, 1701 nt, Artificial Sequence
  derived and/or modified sequence opt3 from hemagglutinin__InfluenzaA__ADM13001
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagcacgccaucgacgagauaacgaacaaggucaauucugugauugagaaaaugaacacccaguuuacagcuguugguaaggaguucaaucaucuggaaaagcggaucgaaaacuuaaauaaaaagguggaugacggguuccuggauaucuggacuuacaacgccgagcuccuuguccuguuggaaaaugagcgcacccuagacuaucacgauagcaacgugaaaaaucuguacgagaagguacgaucacagcucaaaaacaacgcaaaggaaauuggcaauggauguuuugaguucuaucauaagugcgacaacacauguauggaaaguguuaaaaauggcacuuacgauuauccuaaguacuccgaggaagccaaacugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127569 - RNA, 1701 nt, Artificial Sequence; identical to SEQ ID NO: 125849
  derived and/or modified sequence opt3 from hemagglutinin__InfluenzaA__ADM13011

SEQ ID NO: 127570 - RNA, 1701 nt, Artificial Sequence
  derived and/or modified sequence opt3 from hemagglutinin__InfluenzaA__ADM13021
augaaggccauccuggugguccuccuuuacaccuucgcuacagcaaacgccgacacucugugcauuggcuaucacgcgaauaacagcacggauaccauagacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 127571 - RNA, 1701 nt, Artificial Sequence; identical to SEQ ID NO: 126031
  derived and/or modified sequence opt3 from hemagglutinin__InfluenzaA__ADM13031

SEQ ID NO: 127572 - RNA, 1701 nt, Artificial Sequence
  derived and/or modified sequence opt3 from hemagglutinin__InfluenzaA__ADM13041
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauguacacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugagcaaggaagcggcuacgcagcugaccucaaauccacccagaacgccaucgaugagauuacgaauaagguuaacucugugaucgaaaagaugaauacccaguuuacagcugucgguaaggaguucaaccaccuggaaaagcggauagagaauuuaaacaaaaagguggacgauggguuccuggacauuuggacuuacaaugccgaacuccuuguacuguuggagaacgagcgcacccuagauuaucaugacagcaauguuaaaaaccuguacgaaaaggugcgaucacagcucaaaaacaaugcaaaggagaucggcaacggauguuuugaguucuaucacaagugcgauaauacauguauggagagugucaaaaacggcacuuacgacuauccuaaguacuccgaagaggccaaacugaauagagaggaaaucgauggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 127573 - RNA, 1701 nt, Artificial Sequence
  derived and/or modified sequence opt3 from hemagglutinin__InfluenzaA__ADM13051
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 127574 - RNA, 1701 nt, Artificial Sequence
  derived and/or modified sequence opt3 from hemagglutinin__InfluenzaA__ADM13061
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaucuugucaaaccccgaaaggcgcuauuaacacgucccuccccuuccagaauauccacccuaucacuauugguaagugcccaaaguaugugaaaucaacaaagcugcgccuugccaccgggcugagaaacguacccaguauacagagcaggggauuguuuggcgcgaucgccggcuucauugaagggggauggacugguaugguggacggcugguacggguaucaucaccagaaugaacaaggauccggcuacgcagcugaucucaaaucuacacagaacgccaucgacgagauaaccaauaaggucaacagcgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 127575 - RNA, 1701 nt, Artificial Sequence; identical to SEQ ID NO: 126852
  derived and/or modified sequence opt3 from hemagglutinin__InfluenzaA__ADM13071

SEQ ID NO: 127576 - RNA, 1701 nt, Artificial Sequence
  derived and/or modified sequence opt3 from hemagglutinin__InfluenzaA__ADM13081
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuggaucggacaacggcacuugcuauccaggugauuuuauugacuacgaagaacucagggagcagcugucaagcguuaguuccuucgaacgguuugagaucuucccgaagacaucuagcuggcccaaucacgauuccaacaagggggugaccgccgcuuguccucaugcaggagccaaaucauuuuauaagaaucugauauggcucgucaaaaagggcaacaguuacccaaaauuaagcaagucuuauaucaaugacaaggaaaaagaggugcugguacuuuggggcauucaccaccccuccacgucagcugaucaacagagcuuguaccagaacgccgacgcguacguuuucguggggaccagucgcuauucuaagaaauuuaagccugagaucgcaauucgaccaaaaguccgugaucaggaaggaagaaugaauuacuauuggacucugguggagcccggugacaagaucacauucgaagccacuggcaaccuaguggucccuagguacgcuuuugccauggagcggaacgcaggguccggaauaauuaucagcgauaccccaguucaugacugcaauacaaccugucaaacgccgaaaggcgcuauuaacacuucgcuccccuuccagaauauccacccuaucacaauugguaagugcccaaaguaugugaaaucuaccaagcugcgccuugccacugggcugagaaacguacccuccauacagucaaggggauuguuuggcgcgaucgccggcuucauugaagggggauggacagguaugguggacggcugguacggguaucaucaccagaaugagcaaggaaguggcuacgcagcugaucucaaaagcacccagaacgccaucgacgagauaacgaauaaggucaacuccgugauugaaaagaugaauacccaguuuacagcuguugguaaggaguucaaccaccuggaaaagcggaucgagaauuuaaacaaaaagguggaugacggguuccuggauaucuggacuuacaaugccgaacuccuuguccuguuggagaacgagcgcacccuagacuaucaugauucuaaugugaaaaaccuguacgaaaagguacgaagccagcucaaaaacaaugcaaaggagauuggcaacggauguuuugaguucuaucacaagugcgacaauacauguauggagucaguuaaaaacggcacuuacgauuauccuaaguacagugaagaggccaaacugaauagagaggaaaucgacggggugaaacuugaguccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 127577 - RNA, 1701 nt, Artificial Sequence; identical to SEQ ID NO: 126105
  derived and/or modified sequence opt3 from hemagglutinin__InfluenzaA__ADM13091

SEQ ID NO: 127578 - RNA, 1701 nt, Artificial Sequence; identical to SEQ ID NO: 125849
  derived and/or modified sequence opt3 from hemagglutinin__InfluenzaA__ADM13101

SEQ ID NO: 127579 - RNA, 1701 nt, Artificial Sequence
  derived and/or modified sequence opt3 from hemagglutinin__InfluenzaA__ADM13111
augaaggccauccuggugguccuccuuuacaccuucgagacagcuaacgcagacacucugugcauuggcuaucacgccaauaacagcacggauaccguugacacaguguuggaaaagaauguaacugugacccauuccgucaacuuacuggaggauaagcacaaugggaaacuauguaagcucagaggaguggcgccccugcaucuugguaaaugcaacauagcuggcuggauccuggggaauccugaaugugagucuuugucaacagccaguagcugguccuacauuguugaaaccucuucgucagacaacggaacuugcuauccaggcgauuuuaucaauuacgaggagcucagggaacagcugagcaguguguccucuuucgagcgguuugaaauuuucccgaagacaagcuccuggcccaaccacgacucaaauaagggugucaccgcagccuguccucaugcuggggcaaaaaguuuuuauaagaaccugaucuggcucgugaaaaagggaaauagcuacccaaaauuaucuaaguccuauauaaacgauaagggcaaagagguacugguucuuuggggcauccaccaccccucaacgagcgccgaccaacagaguuuguaccagaaugcugaugccuacguguucgucgggacuucucgcuauuccaagaaauuuaagccugagauugcgauccgaccaaaagugcgugaccaggaaggaagaaugaacuacuauuggacccugguggaucccggugacaagauuacauucgaggcaacuggcaaccuagucguuccuagguacgccuuugcuauggaacggaaugccgggagcggaaucauaauuucggauaccccagugcaugacugcaacacaaccugucaaacgccgaauggcgcaaucaacacuucucuccccuuccagaauauucacccuaucacaaucgguaaaugcccaaaguauguaaaguccaccaaacugcgccuugcuacugggcugagaaacgugcccucaauucagaguaggggauuguuuggcgccauagcgggcuucaucgaagggggauggacagguauggucgacggcugguacggguaucaucaccagaaugaacaaggaagcggcuacgccgcagaucucaaguccacccagaacgcuauugacaaaaucacgaauaaggugaacucuguuauagagaaaaugaauacccaguuuacagccguggguaaggaguucaaccaccuggaaaagcggauugagaauuuaaacaaaaaggucgaugacggguuccuggauaucuggacuuacaaugcugaacuccuugugcuguuggagaacgaacgcacccuagacuaucaugauagcaacguuaaaaaucuguacgagaagguacgaucacagcucaaaaacaaugccaaggagaucggcaacggauguuuugaguucuaucacaagugcgacaauacauguauggagagugugaaaaacggcacuuacgauuauccuaaguacuccgaagaggcaaaacugaauagagaagagauugacggggucaaacuugagagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 127580 - RNA, 1701 nt, Artificial Sequence; identical to SEQ ID NO: 124685
  derived and/or modified sequence opt3 from hemagglutinin__InfluenzaA__ADM13121

SEQ ID NO: 127581 - RNA, 1701 nt, Artificial Sequence; identical to SEQ ID NO: 125849
  derived and/or modified sequence opt3 from hemagglutinin__InfluenzaA__ADM13131

SEQ ID NO: 127582 - RNA, 1701 nt, Artificial Sequence; identical to SEQ ID NO: 126013
  derived and/or modified sequence opt3 from hemagglutinin__InfluenzaA__ADM13141

SEQ ID NO: 127583 - RNA, 1701 nt, Artificial Sequence; identical to SEQ ID NO: 126013
  derived and/or modified sequence opt3 from hemagglutinin__InfluenzaA__ADM13151

SEQ ID NO: 127584 - RNA, 1701 nt, Artificial Sequence; identical to SEQ ID NO: 125786
  derived and/or modified sequence opt3 from hemagglutinin__InfluenzaA__ADM13161

SEQ ID NO: 127585 - RNA, 1701 nt, Artificial Sequence; identical to SEQ ID NO: 126334
  derived and/or modified sequence opt3 from hemagglutinin__InfluenzaA__ADM13171

SEQ ID NO: 127586 - RNA, 1701 nt, Artificial Sequence; identical to SEQ ID NO: 126334
  derived and/or modified sequence opt3 from hemagglutinin__InfluenzaA__ADM13181

SEQ ID NO: 127587 - RNA, 1701 nt, Artificial Sequence
  derived and/or modified sequence opt3 from hemagglutinin__InfluenzaA__ADM13191
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucgacuacgaggagcugagggagcagcugagcaguguguccucuuuugaacgguucgagauuuuuccgaagacaagcuccuggcccaaucacgauucaaacaagggugucaccgccgcuuguccucaugcaggggccaaaaguuucuauaagaaucucaucugguuagugaaaaagggaaacagcuacccaaaacugucuaaguccuauauaaaugacaagggcaaagaaguacuuguuuuguggggcauccaccaccccucaacgagcgcugaucaacagagucuguaccagaacgccgacgcguacguguuugucgggacuucucgcuauuccaagaaauucaagccugagauugcaauccgaccaaaagugcgugaucaggagggaagaaugaauuacuauuggacccuaguggaacccggugacaagauuacauuugaggccacuggcaaccucgucguuccuagguacgcuuucgccauggaacggaacgcagggagcggaaucauaauuucggauaccccagugcaugacugcaauacaaccugucaaacgccgaaaggcgcuaucaacacuucucugcccuuucagaauauucacccuaucacaaucgguaagugcccaaaguauguaaaauccaccaaacuucgccuggccacuggguugagaaacgugcccucaauucagaguaggggacucuucggcgcgauagccggcuuuaucgaagggggauggacagguauggucgacggcugguacggguaucaucaccagaaugaacaaggaagcggcuacgcagcugaucugaaguccacccagcacgccauugacgagaucacgaacaagguaaauucuguuauagagaaaaugaacacccaguucacagcuguggguaaggaauuuaaucauuuagagaagcggauugaaaaccugaauaaaaaggucgaugacggguuccucgauaucuggacuuacaacgccgagcuucugguguugcuagaaaaugagcgcacccuggacuaucacgauagcaacgugaaaaaucucuacgagaagguucgaucacagcugaaaaacaacgcaaaggaaaucggcaauggauguuucgaguuuuaucauaagugcgacaacacauguauggaaagugugaaaaauggcacuuacgauuauccuaaguacuccgaggaagccaaacuuaacagagaggagauugacggggucaagcuggaaagcaccaggaucuaucaaauuuuggcuauauacucuacaguggcgucaagucucguccuggugguuagcuuaggagcaaucuccuucuggaugugcucuaaugguucgcugcagugccggauuuguaucuga

SEQ ID NO: 127588 - RNA, 1701 nt, Artificial Sequence
  derived and/or modified sequence opt3 from hemagglutinin__InfluenzaA__ADM13211
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaauagcuccccuucaucuggguaaaugcaacaucgccggcuggauuuuggggaauccugagugugaaucucucucaacagcaaguagcugguccuacaucguggagaccucuucgucagacaacggaacuugcuauccaggcgauuucauugacuacgaggagcugagggagcagcugagcaguguuuccucuuuugaacgguucgagaucuuuccgaagacaagcuccuggcccaaucacgauucaaacaagggugugaccgccgcuuguccucaugcaggggccaaaaguuucuauaagaaucucauaugguuagucaaaaagggaaacagcuacccaaaacugucuaaguccuauaucaaugacaagggcaaagaagugcuuguauuguggggcauucaccaccccucaacgagcgcugaucaacagagucuguaccagaacgccgacgcguacguuuuuguggggacuucucgcuauuccaagaaauucaagccugagaucgcaauucgaccaaaaguccgugaucaggagggaagaaugaauuacuauuggacccuaguggaacccggugacaagaucacauuugaggccacuggcaaccucguggucccuagguacgcuuucgccauggaacggaacgcagggagcggaauaauuaucucggauaccccaguucaugacugcaauacaaccugucaaacgccgaaaggcgcuauuaacacuucucugcccuuucagaauauccacccuaucacaauugguaagugcccaaaguaugugaaauccaccaaacuucgccuggccacuggguugagaaacguacccucaauacagaguaggggacucuucggcgcgaucgccggcuuuauugaagggggauggacagguaugguggacggcugguacggguaucaucaccagaaugaacaaggaagcggcuacgcagcugaucugaaguccacccagaacgccaucgacgagauaacgaauaaggucaacucugugauugagaaaaugaauacccaguucacagcuguugguaaggaauuuaaccacuuagagaagcggaucgaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaauuggcaacggauguuucgaguuuuaucacaagugcgacaauacauguauggaaaguguuaaaaacggcacuuacgauuauccuaaguacuccgaggaagccaaacuuaauagagaggagaucgacggggugaagcuggaaagcaccaggauuuaucaaauauuggcuaucuacucuacagucgcgucaagucucgugcuggucgugagcuuaggagcaauuuccuucuggaugugcucuaacgguucgcugcagugccggaucuguaucuga

SEQ ID NO: 127589 - RNA, 1701 nt, Artificial Sequence; identical to SEQ ID NO: 127588
  derived and/or modified sequence opt3 from hemagglutinin__InfluenzaA__ADM13221

SEQ ID NO: 127590 - RNA, 1701 nt, Artificial Sequence
  derived and/or modified sequence opt3 from hemagglutinin__InfluenzaA__ADM13231
augaaggccauccuggugguccuccuuuacaccuucgagacagcuaacgcagacacucugugcauuggcuaucacgccaauaacagcacggauaccguugacacaguguuggaaaagaauguaacugugacccauuccgucaacuuacuggaggauaagcacaaugggaaacuauguaagcucagaggaguggcgccccugcaucuugguaaaugcaacauagcuggcuggauccuggggaauccugaaugugagucuuugucaacagccaguagcugguccuacauuguugaaaccucuucgucagacaacggaacuugcuauccaggcgauuuuaucaauuacgaggagcucagggaacagcugagcaguguguccucuuucgagcgguuugaaauuuucccgaagacaagcuccuggcccaaccacgacucaaauaagggugucaccgcagccuguccucaugcuggggcaaaaaguuuuuauaagaaccugaucuggcucgugaaaaagggaaauagcuacccaaaauuaucuaaguccuauauaaacgauaagggcaaagagguacugguucuuuggggcauccaccaccccucaacgagcgccgaccaacagaguuuguaccagaaugcugaugccuacguguucgucgggacuucucgcuauuccaagaaauuuaagccugagauugcgauccgaccaaaagugcgugaccaggaaggaagaaugaacuacuauuggacccugguggagcccggugauaagauuacauucgaagcaacuggcaaccuagucguuccuagguacgccuuugcuauggagcggaaugccgggagcggaaucauaauuucggacaccccagugcaugauugcaacacaaccugucaaacgccgaauggcgcaaucaacacuucucuccccuuccagaauauucacccuaucacaaucgguaaaugcccaaaguauguaaaguccaccaaacugcgccuugcuacugggcugagaaacgugcccucaauucagaguaggggauuguuuggcgccauagcgggcuucaucgaagggggauggacagguauggucgacggcugguacggguaucaucaccagaaugagcaaggaagcggcuacgccgcagaccucaaguccacccagaacgcuauugauaaaaucacgaauaaggugaacucuguuauagagaaaaugaauacccaguuuacagccguggguaaggaguucaaccaccuggaaaagcggauugaaaauuuaaacaaaaaggucgacgauggguuccuggacaucuggacuuacaaugcugagcuccuugugcuguuggaaaacgagcgcacccuagauuaucaugacagcaacguuaaaaaucuguacgagaagguacgaucacagcucaaaaacaaugccaaggaaaucggcaacggauguuuugaguucuaucacaagugcgauaauacauguauggaaagugugaaaaacggcacuuacgacuauccuaaguacuccgaggaagcaaaacugaauagagaggagauugauggggucaaacuugaaagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 127591 - RNA, 1701 nt, Artificial Sequence; identical to SEQ ID NO: 125849
  derived and/or modified sequence opt3 from hemagglutinin__InfluenzaA__ADM13241

SEQ ID NO: 127592 - RNA, 1701 nt, Artificial Sequence
  derived and/or modified sequence opt3 from hemagglutinin__InfluenzaA__ADM13251
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacgggaugccgggagcggaaucauaauuucggacacaccagugcaugacugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgauggcugguacggguaucaucaccagaacgaacaaggaagcggcuacgccgcagaccucaaauccacgcagaaugcuauugauaagaucaccaacaaaguuaauucugugauagagaagaugaacacacaguuuacugccguggguaaggaguucaaucaccuggaaaaacggauugagaacuuaaauaagaaagucgacgauggguuccuggacaucuggaccuacaacgcugaacuccuugugcuguuggagaaugaacgcacacuagauuaucaugacagcaacguaaagaaucuguacgagaaaguucgaucacagcucaagaacaacgccaaggagaucggcaauggauguuuugaguucuaucacaaaugcgauaacacuuguauggaaagugugaagaauggcaccuacgacuauccuaaauacuccgaagaggcaaagcugaacagagaagagauugauggggucaaacuugagagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 127593 - RNA, 1701 nt, Artificial Sequence
  derived and/or modified sequence opt3 from hemagglutinin__InfluenzaA__ADM13261
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuggaucggacaacggcacuugcuauccaggugauuuuauugacuacgaagaacucagggagcagcugucaagcguuaguuccuucgaacgguuugagaucuucccgaagacaucuagcuggcccaaucacgauuccaacaagggggugaccgccgcuuguccucaugcaggagccaaaucauuuuauaagaaucugauauggcucgucaaaaagggcaacaguuacccaaaauuaagcaagucuuauaucaaugacaagggcaaagaagugcugguacuuugggggauucaccaccccuccacgucagcugaucaacagagcuuguaccagaacgccgacgcguacguuuucgugggaaccagucgcuauucuaagaaauuuaagccugagaucgcaauucgaccaaaaguccgugaucaggaggguagaaugaauuacuauuggacucugguggaacccggcgacaagaucacauucgaggccacugggaaccuaguggucccuagguacgcuuuugccauggaacggaacgcaggauccggcauaauuaucagcgauaccccaguucaugacugcaauacaaccugucaaacgccgaaaggugcuauuaacacuucgcuccccuuccagaauauccacccuaucacaauugggaagugcccaaaguaugugaaaucuaccaagcugcgccuugccacuggacugagaaacguacccuccauacagucaaggggcuuguuuggcgcgaucgccggguucauugagggagguuggacaggcaugguggacgggugguacggauaucaucaccagaaugaacaaggcagugguuacgcagcugaucucaaaagcacccagaacgccaucgacgagauaacgaauaaggucaacuccgugauugagaaaaugaauacccaguuuacagcuguugggaaggaguucaaccaccuggagaagcggaucgaaaauuuaaacaaaaagguggaugacggcuuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggaaacggcuguuuugaguucuaucacaagugcgacaauacauguauggaaucaguuaaaaacgggacuuacgauuauccuaaguacagugaggaagccaaacugaauagagaggagaucgacggagugaaacuugaauccaccaggauuuaucaaauacuggcuaucuacagcacagucgcgucuucauuggugcucgucgugagucugggugcaauuagcuuuuggaugugcuccaacggcucuuuacagugccggaucuguaucuga

SEQ ID NO: 127594 - RNA, 1701 nt, Artificial Sequence
  derived and/or modified sequence opt3 from hemagglutinin__InfluenzaA__ADM13271
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggauccaucaaauucuggcuauauauucuacaguggcgucaaguuugguccucgugguuagccugggagcaaucuccuuuuggaugugcucuaacgguucguuacagugccggauuuguaucuga

SEQ ID NO: 127595 - RNA, 1701 nt, Artificial Sequence; identical to SEQ ID NO: 127590
  derived and/or modified sequence opt3 from hemagglutinin__InfluenzaA__ADM13281

SEQ ID NO: 127596 - RNA, 1701 nt, Artificial Sequence; identical to SEQ ID NO: 125786
  derived and/or modified sequence opt3 from hemagglutinin__InfluenzaA__ADM13291

SEQ ID NO: 127597 - RNA, 1701 nt, Artificial Sequence
  derived and/or modified sequence opt3 from hemagglutinin__InfluenzaA__ADM13301
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaaggaaaacagcuacccaaaauuaucuaaguccuauaucaaugacaagggaaaagaggugcugguacuuuggggcauucaccaccccucaacgagcgcugaucaacagaguuuguaccagaacguugacgccuacguguucgucggcacuucucgcuauuccaagaaauuuaagccugagaucgcgauucgaccaaaagugcgugaucaggaagggagaaugaauuacuauuggacccugguggagcccggagacaagaucacauucgaagcaacugguaaccuagucguuccuagguacgccuuugcuauggagcggaacgccggcagcgggauaauuaucucggauaccccagugcaugacugcaauacaaccugucaaacgccgaaaggagcaauuaacacuucucuccccuuccagaauauccacccuaucacaauuggcaagugcccaaaguauguaaaauccaccaagcugcgccuugcuacuggucugagaaacgugcccucaauacagaguaggggguuguuuggagccaucgcgggcuucauugaaggcggguggacaggaauggucgacgguugguacggcuaucaucaccagaaugagcaagggagcggauacgccgcagaucucaaauccacccagaacgcuaucgacgagauaacgaauaaggugaacucuguuauugaaaagaugaauacccaguuuacagccgugggcaaggaguucaaccaccuggaaaagcggaucgagaauuuaaacaaaaaggucgaugacgguuuccuggauaucuggacuuacaaugcugaacuccuugugcuguuggagaacgagcgcacccuagacuaucaugauagcaauguuaaaaaccuguacgaaaagguacgaucacagcucaaaaacaaugccaaggagauugggaacggcuguuuugaguucuaucacaagugcgacaauacauguauggagagugugaaaaacggaacuuacgauuauccuaaguacuccgaagaggcaaaacugaauagagaggaaaucgacggcgucaaacuugagagcaccaggauuuaucaaauacuggccaucuacucuacaguggcuucaaguuugguccucgugguuagccugggggcgauuuccuuuuggaugugcucuaacggaucguuacagugccggaucuguaucuga

SEQ ID NO: 127598 - RNA, 1701 nt, Artificial Sequence
  derived and/or modified sequence opt3 from hemagglutinin__InfluenzaA__ADM13311
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaaaauaagcacaacgggaaacuauguaagcucagaggagucucuccccugcaucuugguaaaugcaauaucgcuggcuggauucuggggaacccugagugugaaucauugaguacagccagcuccuggucuuacaucguggagaccucgucaagcgauaauggaacuugcuauccaggcgacuuuauugauuacgaggagcucagggagcagcugaguuccguuucuagcuucgaacgguuugagaucuucccgaagacauccucauggcccaaccacgacaguaauaagggugugaccgcagccuguccucaugcuggggcaaagagcuuuuauaagaaccugauauggcucgucaaaaagggaaauucuuacccaaaauuauccaagucauauaucaacgauaagggcaaagaagugcugguacuuuggggcauucaccaccccagcacgagugccgaccaacagucuuuguaccagaaugcugaugccuacguuuucguggggacuucccgcuauagcaagaaauuuaagccugagaucgcgauucgaccaaaaguccgugaccaggagggaagaaugaacuacuauuggacccugguggaacccggugauaagaucacauucgaggcaacuggcaaccuaguggucccuagguacgccuuugcuauggaacggaaugccgggucgggaauaauuaucucugacaccccaguucaugauugcaacacaaccugucaaacgccgaaaggcgcaauuaauacuucccuccccuuccagaacauccacccuaucacaauugguaagugcccaaaguaugugaaaucaaccaagcugcgccuugcuacugggcugagaaauguacccaguauacagagcaggggauuguuuggcgccaucgcgggcuucauugaagggggauggacagguaugguggacggcugguacggguaucaucaccagaacgaacaaggauccggcuacgccgcagaccucaaaucuacccagaaugcuaucgaugagauaacgaacaaggucaauagcgugauugagaaaaugaacacccaguuuacagccguugguaaggaguucaaucaccuggaaaagcggaucgaaaacuuaaauaaaaagguggacgauggguuccuggacaucuggacuuacaacgcugagcuccuuguccuguuggaaaaugagcgcacccuagauuaucaugacucaaacgugaaaaaccuguacgagaagguacgaagucagcucaaaaauaacgccaaggaaauuggcaauggauguuuugaguucuaucacaagugcgauaacacauguauggaauccguuaaaaauggcacuuacgacuauccuaaguacagcgaggaagcaaaacugaacagagaggagaucgauggggugaaacuugaaucuaccaggauuuaucaaauacuggccaucuacucaacagcugcgaguagcuugguccucguggucucccugggagcaauuucuuuuuggaugugcucgaaugguagcuuacagugccggaucuguaucuga

SEQ ID NO: 127599 - RNA, 1701 nt, Artificial Sequence; identical to SEQ ID NO: 125849
  derived and/or modified sequence opt3 from hemagglutinin__InfluenzaA__ADM13321

SEQ ID NO: 127600 - RNA, 1701 nt, Artificial Sequence
  derived and/or modified sequence opt3 from hemagglutinin__InfluenzaA__ADM13331
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127601 - RNA, 1701 nt, Artificial Sequence; identical to SEQ ID NO: 126298
  derived and/or modified sequence opt3 from hemagglutinin__InfluenzaA__ADM13341

SEQ ID NO: 127602 - RNA, 1701 nt, Artificial Sequence; identical to SEQ ID NO: 127264
  derived and/or modified sequence opt3 from hemagglutinin__InfluenzaA__ADM13351

SEQ ID NO: 127603 - RNA, 1701 nt, Artificial Sequence; identical to SEQ ID NO: 124345
  derived and/or modified sequence opt3 from hemagglutinin__InfluenzaA__ADM13442

SEQ ID NO: 127604 - RNA, 1701 nt, Artificial Sequence; identical to SEQ ID NO: 124345
  derived and/or modified sequence opt3 from hemagglutinin__InfluenzaA__ADM13443

SEQ ID NO: 127605 - RNA, 1701 nt, Artificial Sequence; identical to SEQ ID NO: 124345
  derived and/or modified sequence opt3 from hemagglutinin__InfluenzaA__ADM13444

SEQ ID NO: 127606 - RNA, 1701 nt, Artificial Sequence; identical to SEQ ID NO: 125292
  derived and/or modified sequence opt3 from hemagglutinin__InfluenzaA__ADM13445

SEQ ID NO: 127607 - RNA, 1701 nt, Artificial Sequence; identical to SEQ ID NO: 124345
  derived and/or modified sequence opt3 from hemagglutinin__InfluenzaA__ADM13446

SEQ ID NO: 127608 - RNA, 1701 nt, Artificial Sequence
  derived and/or modified sequence opt3 from hemagglutinin__InfluenzaA__ADM13447
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuacucagugcugaaugucaccaugcccaacaaugacaacuucgauaaacuuuauauuuggggcgugcaccauccuaguacaaaucaagagcagaccagcuuguacguacaggcaucugggcguguuacgguguccacuagaaggucacagcaaacaaucauuccaaacaucggaagccggcccuggguccgcggccugaguucuagaauauccauuuauuggaccaucgugaagccuggugacgugcuagucauuaacagcaaugggaaccucaucgccccaaggggauacuuuaagaugcggacuggcaagucgucuaucaugcgcuccgacgcuccgauugauacauguauaucagagugcaucacccccaauggcaguauuccuaacgacaaaccauuccagaauguuaacaagaucacguacggggccugucccaaauaugugaagcagaauacccugaaacuugcgacaggaaugcgaaacguaccugaaaagcagacuagaggucuguuuggcgcaauagccggguucauugagaauggaugggaaggcaugaucgaugguugguacggguuuaggcaccaaaacagcgagggcaccggacaggcugccgacuugaaguccacacaggcagcuaucgaucaaauuaauggcaaacucaaccgggugaucgagaagacuaaugaaaaauuccaccagauugagaaggaguucucugaagucgaagggcguauacaggaccuggagaaauauguggaggauaccaagaucgacuuauggagcuacaacgccgaacugcucguugcgcuugagaaucagcauacaauugaucugaccgacucagaaaugaacaaguuguuugagaaaacucgcagacaacuaagggaaaacgccgaggauaugggaaaugguugcuucaagaucuaucacaaaugugacaacgcaugcaucgagaguauucggaauggcacguacgaccaugauguguaucgagacgaagcucugaacaaucgcuuucagauaaagggggucgagcucaaauccggauacaaggauuggauccuguggauuagcuucgccaucucuugcuuucuucugugugugguauugcucggcuucauuaugugggcuugccagagagguaacaucagguguaauauaugcaucuga

SEQ ID NO: 127609 - RNA, 1701 nt, Artificial Sequence; identical to SEQ ID NO: 124415
  derived and/or modified sequence opt3 from hemagglutinin__InfluenzaA__ADM13448

SEQ ID NO: 127610 - RNA, 1701 nt, Artificial Sequence
  derived and/or modified sequence opt3 from hemagglutinin__InfluenzaA__ADM13449
augaagaccaucauugcccugagcuacauauucugccucgcuuuuggccaggaccuucccgggaacgauaauuccacagcaacucuguguuugggacaccaugccgugccuaacgguacguuagucaaaaccaucacagacgaucaaauugagguuacuaaugcgaccgaacuggugcagucuucaaguacaggcaagaucugcaacaauccacacaggauucuagacgggaucgauuguacccucauagacgcucugcuuggagauccgcauugcgacguauuccagaacgagacuugggaucuguuuguggaaagaagcaaagccuucuccaauuguuaucccuacgacgucccugauuaugcaucuuugcggucgcucguggccucaagcggcacacuggaguuuaucaccgaagguuucacguggacugggguuacccagaacggaggcaguaaugcuugcaagcgcggcccaggguccggauuuuucucucgacugaacuggcucacaaaaagcgguuccacuuaccccguguuaaaugucaccaugccuaacaaugacaacuuugauaagcuguauauuuggggcgugcaccauccaucaacaaaucaagagcagaccagucuuuacguacaggcaagcgggcguguuacggugucuacuagaaggucccagcaaacaaucauucccaacaucgagucacggccuuggguccgcggauugagcaguagaauaucuauuuauuggaccaucgugaacccaggcgacgugcuggucauuaauuccaacgguaaucuaaucgccccgaggggguacuucaagaugcggacuggaaaaagcucgaucaugcgcucugacgcucccauugauacauguauauccgaaugcaucaccccuaacggcucaauuccaaaugacaagcccuuucagaacguuaauaaaaucacguacggcgccuguccuaaguaugugaaacagaacacccucaagcuggcgacagggaugcgaaauguaccagagaagcagacuagaggacuuuucggugcaauagccggcuuuauugaaaacgggugggagggaaugaucgauggcugguacgguuucaggcaccaaaauagugaggggaccggccaggcugccgaccugaaaagcacacaggcagcuaucgaucaaauuaacggaaaguugaaucgggugaucgagaaaacuaacgaaaaguuccaccagauugaaaaagaguuuuccgaagucgagggccguauacaggaccucgagaaguauguggaagauaccaaaaucgaccuguggucuuacaaugccgaguuacugguugcgcucgaaaaccagcauacaauugaucuuaccgacagcgagaugaacaagcuguucgaaaagacucgcagacaauugagggagaaugccgaggauauggggaacggaugcuuuaaaaucuaucacaagugugacaaugcaugcaucgaaucaauucggaacgguacguacgaccaugauguguaucgagacgaggcucuaaauaaccgcuuccagauaaaaggcgucgaacugaagaguggguacaaagauuggauccucuggauuuccuuugccaucagcugcuuccugcuuugugugguacuguugggauuuauuaugugggcuugccagagaggcaauaucagguguaacauaugcaucuga

SEQ ID NO: 127611 - RNA, 1701 nt, Artificial Sequence; identical to SEQ ID NO: 124447
  derived and/or modified sequence opt3 from hemagglutinin__InfluenzaA__ADM13450

SEQ ID NO: 127612 - RNA, 1701 nt, Artificial Sequence
  derived and/or modified sequence opt3 from hemagglutinin__InfluenzaA__ADM13451
augaagaccaucauugcccugagcuacauauucugccucgcucuuggccaggaccugcccgggaacgauaauagaacagcaacuuuguguuuaggacaccaugccgugccuaacgguacgcuggucaaaaccaucacagacgaucaaauugagguuacuaaugcgaccgaacuugugcaguccucuucaacaggcaagaucugcaacaauccacacaggauucucgacgggaucgauuguacccugauagacgcucuacugggagauccgcauugcgacguauuucagaacgagacuugggauuuguucguggaacggaguaaagccuuuagcaauuguuaucccuacgacgucccugauuaugcaucccuccgcucucugguggccucgucaggcacacuggaguucaucaccgaagguuuuacguggacugggguuacccagaacggaggcagcaaugcuugcaagcgaggcccagggaguggauucuuuucccgucucaacugguuaacaaaaucugguagcacuuaccccgugcugaaugucaccaugccuaacaaugacaacuucgauaaacuuuauauuuggggcgugcaccauccauccacaaaucaagagcagaccucauuguacguacaggcaagugggagaguuacggugagcacuaggcggucucagcaaacaaucauucccaacaucggaucccgcccuugggucagaggccugucaagcaggauaaguauuuauuggaccaucgugaagccaggugacgugcuagucauuaacucuaaugggaaccucaucgccccgcggggauacuuuaagaugcgcacuggcaaguccagcaucaugcgaucggacgcucccauugauacauguauaucugagugcaucaccccuaauggcuccauuccaaacgacaaacccuuccagaauguuaacaagaucacguacggggccuguccuaaauaugugaagcagaauacccugaaacuugcgacaggaaugagaaacguaccagaaaagcagacuaggggucuguuuggcgcaauagccggguucauugagaauggaugggaaggcaugaucgaugguugguacggguuucggcaccaaaacucagagggcaccggacaggcugccgacuugaagaguacacaggcaacuaucgaucaaauuaauggcaaacucaaccgugugaucgagaagaccaaugaaaaauuccaccagauugagaaggaguucagcgaagucgaagggcgcauacaggaccuggagaaauauguggaggauacaaagaucgacuuaugguccuacaacgcugaacugcucguugcccuugagaaucagcauaccauugaucugacugacucugaaaugaacaaguuguuugagaaaacgagaaggcaacuacgggaaaacgcggaggauaugggaaaugguugcuucaagaucuaucacaaaugugacaacgccugcaucgagagcauucgaaauggcacauacgaccaugauguguaucgcgacgaagcacugaacaauagauuucagauaaagggggucgagcucaaaucaggauacaaggauuggauccuguggauuaguuucgcuaucuccugcuuucuucugugugugguauugcucggcuucauuaugugggccugccagagggguaacauccgguguaauauaugcaucuga

SEQ ID NO: 127613 - RNA, 1701 nt, Artificial Sequence; identical to SEQ ID NO: 124332
  derived and/or modified sequence opt3 from hemagglutinin__InfluenzaA__ADM13452

SEQ ID NO: 127614 - RNA, 1701 nt, Artificial Sequence
  derived and/or modified sequence opt3 from hemagglutinin__InfluenzaA__ADM14467
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguagucaugcaggggccaaaucauuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugaucaggagggaagaaugaauuacuauuggacccugguggaaccaggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagucaauucaccccaucacaaucgguaagugcccuaaguauguaaaaaguaccaagcugcgccuugccacugggcugagaaaugugccaagcauucaguccaggggauuguuuggcgcgauagccggcuucaucgaagggggauggacagguauggucgacggcugguacggguaucaucaccagaacgaacaaggaucuggcuacgcagcugaucucaaaagcacccagaaugccauugacaagaucacgaacaaagugaauagcguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauaguaacguaaagaaucuguacgagaaaguucgaucccagcucaagaacaacgcaaaggagaucggcaauggauguuuugaguucuaucacaaaugcgacaacacauguauggaaagcgugaagaauggcacuuacgauuaucccaaauacucugaagaggccaagcugaacagagaagagauugacggggucaaacuugagucaaccaggaucuaucaaauucuggcuauauacaguacaguggcgagcuccuugguccucgugguuucucugggagcaaucucguuuuggaugugcagcaaugguuccuuacagugccggauuuguaucuga

SEQ ID NO: 127615 - RNA, 1695 nt, Artificial Sequence
  derived and/or modified sequence opt3 from hemagglutinin__InfluenzaA__ADM14516
augaaggccauccuggugguccuccuuuacaccuucgcuacagcaaacgccgacacucugugcauuggcuaucacgcgaauaacagcacggauaccguuaauacaguguuggagaagaacguaacugugacccauuccgucaauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcacugaccaacagaguuuguaccagaaugcugaugccuacguguucgucgggaccucucgcuauuccaagaaauuuaagccugagauugcgauccgaccaaaagugcgugaccaggagggaagaaugaacuacuauuggacacugguggaacccggugauaagauuacuuucgaggcaaccggcaaccuagucguuccuagguacgccuuugcuauggaacggaaugccgggagcggaaucauaauuucggacacaccagugcaugauugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgacggcugguacggguaucaucaccagaacgaacaaggaagcggcuacgccgcagaccucaaauccacgcagaaugcuauugaugagaucaccaacaagguaaauucuguuauagagaaaaugaacacacaguuuacugccguggguaaggaguucaaucaccuggaaaagcggauugaaaacuuaaauaaaaaggucgacgauggguuccuggacaucuggaccuacaacgcugagcuccuugugcuguuggaaaaugagcgcacacuagauuaucaugacagcaacgugaaaaaccuguacgagaagguucgaucacagcucaaaaauaacgccaaggaaaucggcaauggauguuuugaguucuaucacaagugcgauaacacuuguauggaaagugugaaaaauggcaccuacgacuauccuaaguacuccgaggaagcaaaacugaacagagaggagauugauggggucaaacuugaaagcacaaggaucuaucaaauucuggccauauacucuaccguggcuucaaguuugguccucgugguuagccugggagcgaucuccuuuuggaugugcucuggucauucgugccggauuuguaucuga

SEQ ID NO: 127616 - RNA, 1701 nt, Artificial Sequence
  derived and/or modified sequence opt3 from hemagglutinin__InfluenzaA__ADM14525
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauugacuacgaagaacucagggagcagcugagcagucuguccucuuucgaacgguuugagaucuucccgaagaccagcuccuggcccaaucacgauucaaacaagggugugacggccgcuuguccucaugcaggggccaaaaguuuuuauaagaaucucauuugguuagucaaaaagggaaacagcuacccaaaacugucuaaguccuauaucaaugacaagggcaaagaugugcuuguauuguggggcauacaccaccccucaacuagcgcugaccaacagagucuguaccagaacgccgaugcguacguuuucguggggaccucucgcuauuccaagaaauuuaagccugaaaucgcaauucgaccaaaaguccgugaccaggagggaagaaugaauuacuauuggacacuuguggagcccggugauaagaucacuuucgaagccaccggcaaccucguggucccuagguacgcuuuugccauggagcggaacgcagggagcggaauuaucauaucggacacaccaguucaugacugcaauaccacgugucaaacuccgaaaggcgcuauuaacacaucucugcccuuccagaauauccacccuauuaccaucgguaagugcccaaaguaugugaaauccacuaagcuacgccuggccacaggguugagaaacguacccucaauccagaguaggggacucuuuggcgcgauugccggcuucauagaagggggauggaccgguaugguggauggcugguacggguaucaucaccagaaugagcaaggaagcggcuacgcagcugaccugaaauccacgcagaacgccaucgaugaaauuaccaauaaggucaacucugugaucgagaaaaugaauacacaguuuacugcuguugguaaggaguucaaccacuuagaaaagcggauagagaaucugaacaaaaagguggacgauggguuccucgacauuuggaccuacaaugccgaacuucuggucuugcuagagaacgaacgcacacuggauuaucaugacagcaaugugaaaaaccucuacgagaagguacgaucacagcugaaaaacaaugcaaaggagaucggcaacggauguuuugaguucuaucacaagugcgauaauacuuguauggagaguguuaaaaacggcaccuacgacuauccuaaguacuccgaagaggccaaacuuaauagagaagagaucgauggggugaagcuggagagcacaaggauuuaucaaaucuuggcuauuuacucuaccgucgcgucaagucucgugcuggucgugagcuuaggagcaauauccuuuuggaugugcucuaacgguucgcugcagugccggaucuguauuuga

SEQ ID NO: 127617 - RNA, 1695 nt, Artificial Sequence
  derived and/or modified sequence opt3 from hemagglutinin__InfluenzaA__ADM14553
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggagacuucucgcuauuccaagaaauuuaagccugagaucgcaauucgaccaaaaguccgugaucaggaagggagaaugaauuacuauuggacccugguggagcccggagacaagaucacauucgaagccacugguaaccuaguggucccuagguacgcuuuugccauggagcggaacgcaggcagcgggauaauuaucucggauaccucuguucaugacugcaauacaaccugucaaacgccaaaaggagcuauuaacacuucccucccguuccagaauauccaccccaucacaauuggcaagugcccuaaguaugugaaaucaaccaagcugcgccuugccacuggucugagaaacguaccaaguauacagagcaggggguuguuuggagcgaucgccggcuucauugaaggcggguggacaggaaugguggacgguugguacggcuaucaucaccagaaugagcaaggguccggauacgcagcugaucucaaaucuacccagaacgccaucgacgagauaacgaauaaggucaacagcgugauugaaaagaugaauacccaguuuacagcuguuggcaaggaguucaaccaccuggaaaagcggaucgagaauuuaaacaaaaagguggaugacgguuuccuggauaucuggacuuacaaugccgaacuccuuguccuguuggagaacgagcgcacccuagacuaucaugauucaaaugugaaaaaccuguacgaaaagguacgaagucagcucaaaaacaaugcaaaggagauugggaacggcuguuuugaguucuaucacaagugcgacaauacauguauggaguccguuaaaaacggaacuuacgauuaucccaaguacagcgaagaggccaaacugaauagagaggaaaucgacggcgugaaacuugagucuaccaggauuuaucaaauacuggcuaucuacucaacagucgcgaguagcuuggugcucgucgugucccugggggcaauuucuuuuuggaugugcucgggacauagcugccggaucuguaucuga

SEQ ID NO: 127618 - RNA, 1701 nt, Artificial Sequence; identical to SEQ ID NO: 125132
  derived and/or modified sequence opt3 from hemagglutinin__InfluenzaA__ADM14562

SEQ ID NO: 127619 - RNA, 1701 nt, Artificial Sequence; identical to SEQ ID NO: 124685
  derived and/or modified sequence opt3 from hemagglutinin__InfluenzaA__ADM14571

SEQ ID NO: 127620 - RNA, 1701 nt, Artificial Sequence
  derived and/or modified sequence opt3 from hemagglutinin__InfluenzaA__ADM14580
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggagaaaaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaguucaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauuaacggggucaaacuugaaagcaccagaaucuaucaaauucuggcuauauacucuacaguggcgucaaguuugguccucgugguuagccugggagcaaucuccuuuuggaugugcucuaaugguucguuacagugcaggauuuguaucuga

SEQ ID NO: 127621 - RNA, 1701 nt, Artificial Sequence
  derived and/or modified sequence opt3 from hemagglutinin__InfluenzaA__ADM14589
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggagaaaaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaauggacaaggcagcgguuacgcagcugaucucaaguccacccagaacgccauugacgaaaucacgaauaaagugaacucuguuauagagaagaugaauacccaguuuacagcuguggggaaggaguucaaccaccuggagaaaaggauugagaauuuaaacaagaaagucgaugacggcuuccuggauaucuggacuuacaaugccgaacuccuugugcuguuggagaacgaacggacccuagacuaucaugauagcaauguaaagaaccuguacgagaaaguucgcucacagcucaagaacaaugcaaaggagaucggaaacggcuguuuugaguucuaucacaaaugcgacaauacauguauggaaagugugaagaacgggacuuacgauuauccuaaauacuccgaagaggccaagcugaaucgagaagagauuaacggagucaaacuugagagcaccagaaucuaucaaauucuggcuauauacucuacaguggcgucaaguuugguccucgugguuagccugggugcaaucuccuuuuggaugugcucuaauggcucguuacagugcaggauuuguaucuga

SEQ ID NO: 127622 - RNA, 1701 nt, Artificial Sequence
  derived and/or modified sequence opt3 from hemagglutinin__InfluenzaA__ADM14599
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugugauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacgagaucacgaauaagguuaacucugugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagauugacggggugaaacuugaaagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 127623 - RNA, 1701 nt, Artificial Sequence; identical to SEQ ID NO: 125845
  derived and/or modified sequence opt3 from hemagglutinin__InfluenzaA__ADM14609

SEQ ID NO: 127624 - RNA, 1701 nt, Artificial Sequence
  derived and/or modified sequence opt3 from hemagglutinin__InfluenzaA__ADM14618
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauaaccacccuauuacaaucgguaagugcccaaaguauguaaaauccaccaagcugcgccuugccacugggcugagaaaugugcccucaauccagaguaggggauuguuuggcgcgauugccggcuucauagaagggggauggacagguauggucgacggcugguacggguaucaucaccagaacgaacaaggaagcggcuacgcagcugaucucaaauccacccagaaugccaucgacgagauuacgaacaagguaaauucuguuaucgagaaaaugaacacccaguuuacagcuguggguaaggaguucaaucaccuggaaaagcggauagaaaacuuaaauaaaaaggucgaugacggguuccuggauauuuggacuuacaacgccgagcuccuugugcuguuggaaaaugagcgcacccuagacuaucaugauagcaacgugaaaaaccuguacgagaagguucgaucacagcucaaaaauaacgcaaaggaaaucggcaauggauguuuugaguucuaucacaagugcgacaacacauguauggaaagugugaaaaauggcacuuacgauuauccuaaguacuccgaggaagccaaacugaacagagaggagaucgacggggucaaacuugaaagcaccaggauuuaucaaauccuggcuauuuacucuacaguggcgucaaguuugguccucgugguuagccugggagcaauauccuuuuggaugugcucuaaugguucguuacagugccggaucuguauuuga

SEQ ID NO: 127625 - RNA, 1701 nt, Artificial Sequence; identical to SEQ ID NO: 124685
  derived and/or modified sequence opt3 from hemagglutinin__InfluenzaA__ADM14627

SEQ ID NO: 127626 - RNA, 1701 nt, Artificial Sequence
  derived and/or modified sequence opt3 from hemagglutinin__InfluenzaA__ADM14655
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguacgcuccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 127627 - RNA, 1701 nt, Artificial Sequence
  derived and/or modified sequence opt3 from hemagglutinin__InfluenzaA__ADM14664
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaacggcgcuaucaauacuucucuccccuuccagaacauucacccuaucacaaucgguaaaugcccaaaguauguaaaguccaccaaacugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaucucaaguccacccagaaugccaucgacgagauaacgaacaaagucaauucugugauugagaagaugaacacccaguuuacagcuguugguaaagaguucaaucaccuggaaaagcggaucgaaaacuuaaauaagaaaguggaugacggguuccuggauaucuggacuuacaacgccgagcuccuuguccuguuggaaaaugagcgcacccuagacuaucaugauagcaacgugaagaaccuguacgagaaaguacgaucacagcucaagaauaacgcaaaagaaauuggcaauggauguuuugaguucuaucacaagugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127628 - RNA, 1701 nt, Artificial Sequence; identical to SEQ ID NO: 124685
  derived and/or modified sequence opt3 from hemagglutinin__InfluenzaA__ADM14673

SEQ ID NO: 127629 - RNA, 1701 nt, Artificial Sequence; identical to SEQ ID NO: 124685
  derived and/or modified sequence opt3 from hemagglutinin__InfluenzaA__ADM14682

SEQ ID NO: 127630 - RNA, 1701 nt, Artificial Sequence; identical to SEQ ID NO: 124685
  derived and/or modified sequence opt3 from hemagglutinin__InfluenzaA__ADM14691

SEQ ID NO: 127631 - RNA, 1701 nt, Artificial Sequence; identical to SEQ ID NO: 125849
  derived and/or modified sequence opt3 from hemagglutinin__InfluenzaA__ADM14700

SEQ ID NO: 127632 - RNA, 1695 nt, Artificial Sequence
  derived and/or modified sequence opt3 from hemagglutinin__InfluenzaA__ADM14709
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaaauagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccaguaaguauucuaaaaaguuuaaaccugagauugcaauccgcccaaaggugcgagaucaggagggacguaugaacuacuauuggacucugguggaacccggugacaaaauuacauucgaggccacuggcaaccuagucguuccuagauacgcuuuugccauggaaaggaaugcaggguccggaaucauaauuagcgauaccccagugcaugacugcaacacaaccugucaaacgccgaagggcgcuaucaauacuucgcuccccuuccagaacauucacccuaucacaaucgguaagugcccaaaauauguaaagucuaccaaacugcggcuugccacugggcugcgcaaugugcccuccauucagucaagaggauuguuuggcgcgauagccggcuucaucgaagggggauggacagguauggucgacggcugguacggguaucaucaccagaacgaacaaggaaguggcuacgcagcugaucucaagagcacccagaaugccauugacgguaucacgaacaaaauaaauuccgugauugagaagaugaacacccaguuuacagcuguugggaaggaguucaaucaccuggagaaaaggaucgagaacuuaaauaagaaaguggaugacggcuuccuggauaucuggacuuacaacgccgaacuccuuguccuguuggagaaugaacggacccuaaacuaucaugacucuaacgugaagaaucuguacgagaaaguacgcagccagcucaagaacaaugcaaaggagauuggaaacggcuguuuugaguucuaucacaaaugcgauaauacauguauggagucaguuaagaacgggacuuacgacuauccuaaauacagugaagaggccaagcugaaucgagaagagaucgauggagugaaacuugaguccaccagaauuuaucaaauacuggcuaucuacagcacagucgcgucuucauuggugcucgucgugagucugggugcaauuagcuuuuggaugugcuccggccauucuugcaggaucuguaucuga

SEQ ID NO: 127633 - RNA, 1701 nt, Artificial Sequence
  derived and/or modified sequence opt3 from hemagglutinin__InfluenzaA__ADM14718
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguauguccucuuucgaacgguuugagauuuucccgaagacaagcuccuggcccaaucacgauucaaacaagggugugaccgccgcuuguccucaugcaggggccaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgcugaucaacagaguuuguaccagaacgccgacgcguacguuuucguggggacuucucgcuauuccaagaaauuuaagccugagauugcaauccgaccaaaaguccgugaucaggagggaagaaugaauuacuauuggacccugguggaacccggugacaagauuacauucgaggccacuggcaaccuaguggucccuagguacgcuuuugccauggaacggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugaacaaggaagcggcuacgcagcugaucucaaauccacccagaacgccauugacaagaucacgaauaaagucaacucugugauagagaagaugaauacccaguuuacagcuguugguaaggaguucaaccaccuggaaaaacggauugagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagaucggcaacggauguuuugaguucuaucacaaaugcgacaauacauguauggaaaguguuaagaacggcacuuacgauuauccuaaauacuccgaagaggccaagcugaauagagaagagauugacggggugaaacuugagagcaccaggaucuaucaaauucuggcuauauacucuacagucgcgucaaguuuggugcucgucgugagccugggagcaaucuccuuuuggaugugcucuaacgguucguuacagugccggauuuguaucuga

SEQ ID NO: 127634 - RNA, 1695 nt, Artificial Sequence
  derived and/or modified sequence opt3 from hemagglutinin__InfluenzaA__ADM14728
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaauuccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagcucaugacugcaacacaaccugucaaacgccgaagggcgccaucaauacuucucuccccuuccagaacauucacccuaucacaaucgguaaaugcccaaaguaugugaaguccaccaaacugcgccuugcgacugggcugagaaauguacccucaauucagaguaggggauuguuuggcgccauagcaggcuucaucgaagggggauggacagguaugguggacggcugguacggguaucaucaccagaacgaacaaggaagcggcuacgcugccgaucucaaguccacccagaaugcuauugacgagaucacgaacaaagucaauucugugauagagaagaugaacacccaguuuacagccguugguaaagaguucaaucaccuggaaaagcggauugaaaacuuaaauaagaaaguggaugacggguuccuggauaucuggacuuacaacgcagagcuccuuguccuguuggaaaaugagcgcacccuagacuaucaugauagcaacgugaagaaccuguacgagaaaguacgaucacagcucaagaauaacgccaaagaaaucggcaauggauguuuugaguucuaucacaagugcgacaacacauguauggaaaguguuaagaauggcacuuacgauuauccuaaauacuccgaggaagcuaagcugaacagagaggagauugacggggugaaacuugaaagcaccaggaucuaucaaauucuggcgauauacucuacagucgcaucaaguuuggugcucgucgugagccugggagccaucuccuuuuggaugugcucuggucauucgugccggauuuguaucuga

SEQ ID NO: 127635 - RNA, 1701 nt, Artificial Sequence
  derived and/or modified sequence opt3 from hemagglutinin__InfluenzaA__ADM14737
augaaggccauccuggugguccuccuuuacaccuucgcuacagcaaacgccgacacucugugcauuggcuaucacgcgaauaacagcacggauaccguuaauacaguguuggagaaaaacguaacugugacccauuccgucaauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggagaaaaaugcagggagcggaaucauaauuucggacaccccagugcaugauugcaacacaaccugucaaacgccgaagggcgcuaucaauacuucucuccccuuccagaacauucacccuaucacaaucgguaagugcccaaaauauguaaaguccaccaaacugcggcuugccacugggcugcgcaaugugcccucaauucagaguagaggauuguuuggcgcgauagccggcuucaucgaagggggauggacagguauggucgacggcugguacggguaucaucaccagaacgaacaaggaagcggcuacgcagcugaccucaaguccacccagaaugccauugaugagaucacgaacaaaguuaauucugugauagagaagaugaacacccaguuuacagcuguggguaaggaguucaaucaccuggagaaaaggauugaaaacuuaaauaagaaagucgacgauggguuccuggacaucuggacuuacaacgccgagcuccuugugcuguuggaaaaugagcggacccuagauuaucaugacagcaacguaaagaaccuguacgagaaaguucgcucacagcucaagaauaacgcaaaggaaaucggcaauggauguuuugaguucuaucacaaaugcgauaacacauguauggaaagugugaagaauggcacuuacgacuauccuaaauacuccgaggaagccaagcugaaccgagaggagauugauggggucaaacuugaaagcaccagaaucuaucaaauucuggcuauauacucuacaguggcgucaaguuugguccucgugguuagccugggagcaaucuccuuuuggaugugcucuaaugguucguuacagugcaggauuuguaucuga

SEQ ID NO: 127636 - RNA, 1701 nt, Artificial Sequence
  derived and/or modified sequence opt3 from hemagglutinin__InfluenzaA__ADM14746
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggguucuggggaauccugagugugaaucuuugucaacagcaaguagcugguccuacaucguggagaccccaucuucggacaacggaacuugcuauccgggcgauuuuauugacuacgaggagcucagggagcagcugucaagcgucaguuccuucgaacgguuugagaucuuccccaagacaucuagcuggccuaaucacgauuccaacaagggugugaccgccgcuuguccacaugcaggggccaaaucauuuuauaagaaucugauuuggcucguuaaaaagggaaacaguuaccccaaauuaagcaagucuuauaucaaugacaagggcaaagaaguacuggugcuuuggggcauacaccacccuuccacgucagcugaucaacagagcuuguaccagaacgccgacgcguacgucuucguggggacuagccgcuauucuaagaaauuuaagccagagaucgcaauucgacccaaagugcgugaucaggagggaagaaugaauuacuauuggacccuggucgaaccuggugacaagaucacauucgaggccacuggcaaccuaguugugccaagguacgcuuuugccauggaacggaacgcaggguccggaauuaucauaagcgauaccccgguacaugacugcaauacaaccugucaaacgcccaaaggcgcuauuaacacuucgcucccuuuccagaauauccacccaauuacaaucgguaagugccccaaguaugugaaaucuaagaaacugcgccuugccaccgggcugagaaacgucccuuccauccagucaaggggauuguuuggcgcgauugccggcuucauagaagggggauggacugguaugguggacggcugguacggguaucaucaccagaaugaacaaggaaguggcuacgcagcugaucucaagagcacacagaacgccaucgacgagauuaccaauaaaguuaacuccgugaucgagaagaugaauacgcaguuuaccgcugucgguaaggaguucaaccaccuggaaaaacggauagaaaauuuaaacaagaaaguggaugacggguuccuggauauuuggacauacaaugccgagcuccuuguacuguuggaaaacgagcgcacucuagacuaucaugauucuaauguuaagaaccuguacgagaaagugcgaagccagcucaagaacaaugcaaaggaaaucggcaacggauguuuugaguucuaucacaaaugcgacaauaccuguauggaaucagucaagaacggcacauacgauuauccaaaauacagugaggaagccaagcugaauagagaggagaucgacggggugaaacuugaauccacuaggauuuaucaaauccuggcuauuuacagcaccgucgcgucuucauuggugcucguugugagucugggagcaauaaguuuuuggaugugcuccaacgguucuuuacagugccggaucuguauuuga

SEQ ID NO: 127637 - RNA, 1695 nt, Artificial Sequence
  derived and/or modified sequence opt3 from hemagglutinin__InfluenzaA__ADM14756
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguuaaaaagggaaacagcuacccaaaauuaucuaaguccuauaucaaugacaagggcaaagaaguacuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacaagauuacgaauaaaguuaacucugugaucgagaagaugaauacccaguuuacagcugucgguaaggaguucaaccaccuggaaaaacggauagagaauuuaaacaagaaaguggaugacggguuccuggauauuuggacuuacaaugccgaacuccuuguacuguuggagaacgaacgcacccuagacuaucaugauagcaauguuaagaaccuguacgagaaagugcgaucacagcucaagaacaaugcaaaggagaucggcaacggauguuuugaguucuaucacaaaugcgacaauacauguauggaaagugucaagaacggcacuuacgauuauccuaaauacuccgaagaggccaagcugaauagagaagagaucgacggggugaaacuugagagcaccaggauuuaucaaauccuggcuauuuacucuacagucgcgucaaguuuggugcucguugugagccugggagcaauauccuuuuggaugugcucuggucauucgugccggaucuguauuuga

SEQ ID NO: 127638 - RNA, 1701 nt, Artificial Sequence; identical to SEQ ID NO: 125849
  derived and/or modified sequence opt3 from hemagglutinin__InfluenzaA__ADM14765

SEQ ID NO: 127639 - RNA, 1695 nt, Artificial Sequence
  derived and/or modified sequence opt3 from hemagglutinin__InfluenzaA__ADM14775
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucggugagugcccaaaguauguaaagucuaccaaacugcgccuugccacugggcugagaaaugugcccuccauucagucaaggggauuguuuggcgcgauagccggcuucaucgaagggggauggacagguauggucgacggcugguacggguaucaucaccagaacgagcaaggaaguggcuacgcagcugaucucaagagcacccagaaugccauugacaaaaucacgaacaaggugaauaguguuauagagaaaaugaacacccaguuuacagcuguggguaaggaguucaaucaccuggagaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccggucauucuugccggauuuguaucuga

SEQ ID NO: 127640 - RNA, 1695 nt, Artificial Sequence
  derived and/or modified sequence opt3 from hemagglutinin__InfluenzaA__ADM14802
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagauaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuuuuggaugugcucuggucauucgugccggaucuguaucuga

SEQ ID NO: 127641 - RNA, 1704 nt, Artificial Sequence
  derived and/or modified sequence opt3 from hemagglutinin__InfluenzaA__ADM14830
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaagaacugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcagaguccgggaucauaauuagcgauaccccagugcaugacugcaauacaaccugucaaacgccgaaaggagcuaucaacacuucgcugcccuuccagaauauucacccuaucacaaucggcaagugcccaaaguauguaaaaucuaccaaacuucgccuggccacugguuugagaaacgugcccuccauucagucaagggggcucuuuggagcgauagccggcuucaucgaaggcggguggacaggaauggucgacgguugguacggcuaucaucaccagaaugagcaagggaguggauacgcagcugaucugaaaagcacccagaacgccauugacgagaucacgaauaaggugaacuccguuauagaaaagaugaauacccaguuuacagcugugggcaaggaguucaaccacuuagaaaagcggauugagaaucugaacaaaaaggucgaugacgguuuccucgauaucuggacuuacaaugccgaacuucugguguugcuagagaacgagcgcacccuggacuaucaugauucuaauguaaagaagcucuacgaaaaaguucgaagccagcugaagaacaacgcaaaggagaucgggaauggcuguuuugaguucuaucacaaaugcgacaacacauguauggagucagugaagaauggaacuuacgauuauccuaaauacagugaagaggccaaacuuaacagagaggaaauugacggcgucaaacuggaguccaccaggaucuaucaaauuuuggcuauauacagcacaguggcgucuucacucguccuggugguuaguuuaggggcaaucagcuuuuggaugugcuccggacauucuugccugcagugucggauuugcaucuga

SEQ ID NO: 127642 - RNA, 1695 nt, Artificial Sequence
  derived and/or modified sequence opt3 from hemagglutinin__InfluenzaA__ADM14848
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacggggucaaacuugaaucuacuaggaucuaucaaauucuggcuauauacucaaccguggcgaguagcuugguccucgugguuucccugggagcaaucucuuuuuggaugugcucgggucauagcugccggauuuguaucuga

SEQ ID NO: 127643 - RNA, 1695 nt, Artificial Sequence
  derived and/or modified sequence opt3 from hemagglutinin__InfluenzaA__ADM14866
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccauuaagcugcgccuugccaccgggcugagaaaugugcccucaauacagaguaggggauuguuuggcgcgaucgccggcuucauugaagggggauggacugguauggucgauggcugguacggguaucaucaccagaacgaacaaggaagcggcuacgcagcugaccucaaauccacacagaaugccaucgaugagauaaccaacaagguaaauucuguuauugagaaaaugaacacgcaguuuaccgcuguggguaaggaguucaaucaccuggaaaagcggaucgaaaacuuaaauaaaaaggucgacgauggguuccuggacaucuggacauacaacgccgagcuccuugugcuguuggaaaaugagcgcacucuagauuaucaugacagcaacgugaaaaaucuguacgagaagguucgaucacagcucaaaaacaacgcaaaggaaauuggcaauggauguuuugaguucuaucacaagugcgauaacaccuguauggaaagugugaaaaauggcacauacgacuauccuaaguacuccgaggaagccaaacugaacagagaggagaucgauggggucaaacuugaaagcacuaggauuuaucaaauacuggcuaucuacucuaccguggcgucaaguuugguccucgugguuagccugggagcaauuuccuuuuggaugugcucuggucauucgugccggaucuguaucuga

SEQ ID NO: 127644 - RNA, 1695 nt, Artificial Sequence
  derived and/or modified sequence opt3 from hemagglutinin__InfluenzaA__ADM14876
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaaggaaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggagagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuggacauucgugccggauuuguaucuga

SEQ ID NO: 127645 - RNA, 1704 nt, Artificial Sequence
  derived and/or modified sequence opt3 from hemagglutinin__InfluenzaA__ADM14885
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaagaacugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucugguuagugaaaaagggaaacaguuacccaaaacugagcaagucuuauauaaaugacaaggaaaaagagguacuuguuuuguggggcauccaccaccccuccacgucagcugaucaacagagccuguaccagaacgccgacgcguacguguucgucggcaccagucgcuauucuaagaaauuuaagccugagauugugauccgaccaaaagugcgugaucaggaagggagaaugaauuacuauuggacucuagucgagcccggagacaagauuacauucgaagcaacugguaaccucguugugccuagguacgccuuugcuauggagcggaacgccgaauccggcaucauaauuagcgauaccccaguacaugacugcaauacaaccugucaaacgccgaaaggggcaaucaacacuucgcugcccuuccagaauauucacccuaucacaaucggaaagugcccaaaguaugugaaaucuaccaagcugcgccuugcuacuggcuugagaaacguccccuccauucagucaaggggucucuuuggggccauagcgggauucaucgagggcggcuggacagggaugguggacggaugguacgguuaucaucaccagaaugagcaaggcaguggguacgccgcagaucugaaaagcacccagaacgcuauugacgaaaucacgaauaagguuaacuccgugauagagaaaaugaauacccaguuuacagccgucggaaaggaguucaaccacuuagagaagcggauugaaaaucugaacaaaaagguggaugacggcuuccucgauaucuggacuuacaaugcugagcuucugguauugcuagagaacgaacgcacccuggacuaucaugauucuaauguuaaaaagcucuacgagaaagugcgaagccagcugaagaacaacgccaaggaaaucgguaauggguguuuugaguucuaucacaaaugcgacaacacauguauggaaucagucaagaauggcacuuacgauuauccuaaauacagugaggaggcaaaacuuaacagagaagagauugacggagugaagcuggaauccaccaggaucuaucaaauuuuggccauauacagcacagucgcuucuucacucgugcugguugugaguuuaggcgcgaucagcuuuuggaugugcuccgggcauggaucucugcagugccggauuuguaucuga

SEQ ID NO: 127646 - RNA, 1695 nt, Artificial Sequence
  derived and/or modified sequence opt3 from hemagglutinin__InfluenzaA__ADM14894
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaaggaaaaagagguacugguucuuuggggcauccaccaccccucaacgagcgcugaucaacagaguuuguaccagaacgccgacgcguacguguucgucggcacuucucgcuauuccaagaaauuuaagccugagauugugauccgaccaaaagugcgugaucaggaagggagaaugaauuacuauuggacccuggucgagcccggagacaagauuacauucgaagcaacugguaaccuaguugugccuagguacgccuuugcuauggagcggaacgccggcagcgggaucguaauaucggauaccccagugcaugacugcaauacaaccugucaaacgccgaaaggagcaauuaacacuucucuccccuuccagaauauccacccuauuacaaucggcaagugcccaaaguaugucaaauccaccaagcugcgccuugcuacuggucugagaaacgugcccucaauccagaguaggggguuguuuggagccauugcgggcuucauagaaggcggguggacaggaaugguugacgguugguacggcuaucaucaccagaaugagcaagggagcggauacgccgcagaucucaaauccacccagaacgcuaucgacgagauuacgaauaaggugaacucugucaucgaaaagaugaauacccaguuuacagccgugggcaaggaguucaaccaccuggaaaagcggauagagaauuuaaacaaaaagguagaugacgguuuccuggauauuuggacuuacaaugcugaacuccuuguucuguuggagaacgagcgcacccuagacuaucaugauagcaaugugaaaaagcuguacgaaaaaguccgaucacagcucaagaacaacgccaaggagaucgggaauggcuguuuugaguucuaucacaaaugcgacaacacauguaugaagagugugaaaaauggaacuuacgauuauccuaaguacuccgaggaagcaaaacugaacagagaggagaucgacggcgucaaacuugaaagcaccaggauuuaucaaauccuggccauuuacucuacaguggcuucaaguuugguucucgugguaagccugggggcgauauccuuuuggaugugcucuggacauucgugccggaucuguauuuga

SEQ ID NO: 127647 - RNA, 1695 nt, Artificial Sequence
  derived and/or modified sequence opt3 from hemagglutinin__InfluenzaA__ADM14903
augaaggccauccuggugguccuccuuugcaccuucgcuacagcaaacgccgacacucuguguauuggcuaccacgcgaauaacagcacggauaccguugacacaguguuggagaaaaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaggagcucagggagcagcugagcaguguguccucuuucgaacgguuugagauuuucccgaagacaagcuccuggcccaaucacgauucaaacaagggugucaccgccgcuugcccucaugcaggggccaaaaguuuuuacaagaaucugaucuggcucgugaaaaagggaaacagcuauccaaaauuaucuaaguccuacauaaaugacaagggcaaagaaguacugguucuuuggggcauccaccaccccucaacgagcgcugaucaacagaguuuguaucagaacgccgacgcguacguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcaugacuguaauacaaccugccaaacgccgaaaggcgcuaucaacacuucucuccccuuccagaauauucacccuaucacaaucgguaaguguccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaucaccagaaugaacaaggaagcggcuaugcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaccaugauagcaauguaaagaaccuguaugagaaaguucgaucacagcucaagaacaaugcaaaggagaucggcaacggaugcuuugaguucuaccacaaaugugacaauacaugcauggaaagugugaagaacggcacuuaugauuacccuaaauauuccgaagaggccaagcugaauagagaagagauugacggggucaaacuugagagcaccaggaucuaccaaauucuggcuauauauucuacaguggcgucaaguuugguccucgugguuagccugggagcaaucuccuuuuggaugugcucuggucauucgugucggauuugcaucuga

SEQ ID NO: 127648 - RNA, 1695 nt, Artificial Sequence
  derived and/or modified sequence opt3 from hemagglutinin__InfluenzaA__ADM14912
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccggagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuggucauucgugccggauuuguaucuga

SEQ ID NO: 127649 - RNA, 1695 nt, Artificial Sequence
  derived and/or modified sequence opt3 from hemagglutinin__InfluenzaA__ADM14921
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuggucauucgugccggauuuguaucuga

SEQ ID NO: 127650 - RNA, 1701 nt, Artificial Sequence; identical to SEQ ID NO: 125849
  derived and/or modified sequence opt3 from hemagglutinin__InfluenzaA__ADM14930

SEQ ID NO: 127651 - RNA, 1701 nt, Artificial Sequence
  derived and/or modified sequence opt3 from hemagglutinin__InfluenzaA__ADM14948
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacgcguacguguucgucggaaccagucgcuauucucgaaaguuuaaaccugagauugcaauccguccaaaggugagagaucaggaggguaggaugaauuacuauuggacucugguggaacccggcgacaaaauuacauucgaggccacugggaaccuagucguuccucgguacgcuuuugccauggaacgcaacgcaggauccggcaucauaauuagcgauaccccagugcaugacugcaauacaaccugucaaacgccggagggugcuaucaacacuucgcuccccuuccagaauauucacccuaucacaaucgggaagugcccaaaauauguaaagucuaccaagcugagacuugccacuggacugaggaacgugcccuccauucagucacggggcuuguuuggcgcgauagccggguucaucgaaggagguuggacaggcauggucgacgggugguacggauaucaucaccagaaugagcaaggcagugguuacgcagcugaucucaaaagcacccagaacgccauugacgagaucacgaauaaggugaacuccguuauagaaaagaugaauacccaguuuacagcuguggggaaggaguucaaccaccuggaaaaacgcauugagaauuuaaacaagaaggucgaugacggcuuccuggauaucuggacuuacaaugccgaacuccuugugcuguuggagaacgagcgaacccuagacuaucaugauucuaauguuaaaaaccuguacgaaaagguaagaagccagcucaaaaacaaugcaaaggagaucggaaacggcuguuuugaguucuaucacaaaugcgacaauacauguauggagucagugaagaacgggacuuacgauuauccuaaguacagugaagaggccaaacugaauagggaggaaauugacggagucaaacuugaguccacccggaucuaucaaauucuggcuauauacagcacaguggcgucuucauugguccucgugguuagucugggugcaaucagcuuuuggaugugcuccaacggcucuuuacagugccguauuuguaucuga

SEQ ID NO: 127652 - RNA, 1695 nt, Artificial Sequence
  derived and/or modified sequence opt3 from hemagglutinin__InfluenzaA__ADM14966
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauacuugcuaucuacucaaccguggcgaguagccuggucuuggugguuucccucggagcaauuucuuuuuggaugugcucgggucauagcugccggaucuguaucuga

SEQ ID NO: 127653 - RNA, 1701 nt, Artificial Sequence; identical to SEQ ID NO: 124865
  derived and/or modified sequence opt3 from hemagglutinin__InfluenzaA__ADM14975

SEQ ID NO: 127654 - RNA, 1701 nt, Artificial Sequence
  derived and/or modified sequence opt3 from hemagglutinin__InfluenzaA__ADM14985
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaaggaaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugggcaggaaggaagaaugaauuacuauuggacccugguggagcccggugauaagauuacauucgaagccacuggcaaccuagucguuccuagguacgcuuuugccauggagcggaacgcagggagcggaaucgugauaucggacaccccaguacaugauugcaauacaaccugucaaacgccgaaaggcgcuauuaacacuucucuccccuuccagaauauccacuccauuacaaucgguaagugcccuaaguaugugaaaucaaccaagcugcgccuugccacugggcugagaaacgucccaaguauccagagcaggggauuguuuggcgcgauugccggcuucauagaagggggauggacagguaugguggacggcugguacggguaucaucaccagaaugagcaaggauccggcuacgcagcugaccucaaaucuacccagaacgccaucgaugagauuacgaauaagguuaacagcgugaucgaaaagaugaauacccaguuuacagcugucgguaaggaguucaaccaccuggaaaagcggauagagaauuuaaacaaaaagguggacgauggguuccuggacauuuggacuuacaaugccgaacuccuuguacuguuggagaacgagcgcacccuagauuaucaugacucaaauguuaaaaaccuguacgaaaaggugcgaagucagcucaaaaacaaugcaaaggagaucggcaacggauguuuugaguucuaucacaagugcgauaauacauguauggaguccgucaaaaacggcacuuacgacuaucccaaguacagcgaagaggccaaacugaauagagaggaaaucgauggggugaaacuugagucuaccaggauuuaucaaauccuggcuauuuacucaacagucgcgaguagcuuggugcucguugugucccugggagcaauaucuuuuuggaugugcucgaacgguagcuuacagugccggaucuguauuuga

SEQ ID NO: 127655 - RNA, 1701 nt, Artificial Sequence
  derived and/or modified sequence opt3 from hemagglutinin__InfluenzaA__ADM23841
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccaaucaacgagcgcugaucagcagaguuuguaccagaacgccgacgcguacguguucgucgggacuucucgcuauuccaagaaauuuaagcccgagauugcaauccgaccuaaagugcgugaucaagagggaagaaugaauuacuauuggacccugguggaaccaggugacaagauuacauucgaggccacuggcaaccuagucguucccagguacgcuuuugccauggaacggaacgcagggagcggaaucauaauuucggauaccccugugcaugacugcaauacaaccugucagacgccaaaaggcgcuaucaacacuucucucccguuccagaauauucaccccaucacaaucgguaagugcccuaaguauguaaaauccaccaagcugcgccuugccacugggcugagaaacgugccaucaauucagaguaggggauuguuuggcgcgauagccggcuucaucgaagggggauggacagguauggucgacggcugguacggguaucaucaccaaaaugaacagggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacaacucaaaaacaaugcaaaggaaaucggcaacggauguuuugaguucuaucacaagugcgacaauacauguauggaaagugugaaaaacggcacuuacgauuaucccaaguacuccgaggaagccaaacugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 127656 - RNA, 1701 nt, Artificial Sequence; identical to SEQ ID NO: 125849
  derived and/or modified sequence opt3 from hemagglutinin__InfluenzaA__ADM23843

SEQ ID NO: 127657 - RNA, 1701 nt, Artificial Sequence
  derived and/or modified sequence opt3 from hemagglutinin__InfluenzaA__ADM23844
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaagaacucagggagcagcugucaagcgugaguuccuucgaacgguuugagaucuucccgaagacaucuagcuggcccaaucacgauuccaacaagggugucaccacggccuguccucaugcuggggcaaaaggauuuuauaagaaucugauauggcucgugaaaaagggcaacucauacccaaaauuaaguaagagcuauaucaaugacaagggcaaagaaguacugguucuuugggggauucaccaccaaucuacuuccgccgaucagcagucauuguaccagaacgcugacgccuacguguucgucggaaccagccgcuauaguaagaaauuuaagcccgagaucgcgauucgaccuaaagugcgugaucaagaggguagaaugaauuacuauuggacacugguggaaccaggcgacaagaucacuuucgaggcaaccgggaaccuagucguucccagguacgccuuugcuauggaacggaacgccggaucuggcauaauuaucuccgauacaccugugcaugacugcaauaccacgugucagacuccaaaaggugcaauuaacacaagccucccguuccagaauauccaccccaucaccauugggaagugcccuaaguauguaaaaucgacuaagcugcgccuugcuacaggacugagaaacgugccaucuauacaguccaggggcuuguuuggcgccaucgcgggguucauugagggagguuggaccggcauggucgacgggugguacggauaucaucaccaaaaugaacagggcucagguuacgccgcagaucucaaaaguacgcagaacgcuaucgacaagauaaccaauaaagugaacagcguuauugagaagaugaauacacaguuuacugccguggggaaggaguucaaccaccuggaaaaacggaucgagaauuuaaacaagaaagucgaugacggcuuccuggauaucuggaccuacaaugcugaacuccuugugcuguuggagaacgaacgcacacuagacuaucaugauuccaauguaaagaaccuguacgagaaaguucgaucucaacucaagaacaaugccaaggagauuggaaacggcuguuuugaguucuaucacaaaugcgacaauacuuguauggagagcgugaagaacgggaccuacgauuaucccaaauacucagaagaggcaaagcugaauagagaagagaucgacggagucaaacuugagaguacaaggauuuaucagauacuggccaucuacuccaccguggcuagcucuuugguccucgugguuucacugggugcgauuaguuuuuggaugugcagcaacggcuccuuacagugccggaucuguaucuga

SEQ ID NO: 127658 - RNA, 1701 nt, Artificial Sequence
  derived and/or modified sequence opt3 from hemagglutinin__InfluenzaA__ADM23845
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaggagcucagggagcagcugucaagcgugaguuccuucgaacgguuugagaucuucccgaagacaucuagcuggcccaaucacgauuccaacaagggugucaccacggccuguccucaugcuggggcaaaaucauuuuauaagaaucugauauggcucgugaaaaagggaaacaguuacccaaaauuaagcaagucuuauaucaaugacaagggcaaagaaguacugguucuuuggggcauucaccaccaauccacuucagccgaucagcagagcuuguaccagaacgcugacgccuacguguucgucgggaccagucgcuauucuaagaaauuuaagcccgagaucgcgauucgaccuaaagugcgugaucaagagggaagaaugaauuacuauuggacacugguggaaccaggugacaagaucacuuucgaggcaaccggcaaccuagucguucccagguacgccuuugcuauggaacggaacgccggguccggaauaauuaucagcgauacaccugugcaugacugcaauaccacgugucagacuccaaaaggcgcaauuaacacaucgcucccguuccagaauauccaccccaucaccauugguaagugcccuaaguauguaaaaucuacuaagcugcgccuugcuacagggcugagaaacgugccauccauacagucaaggggauuguuuggcgccaucgcgggcuucauugaagggggauggaccgguauggucgacggcugguacggguaucaucaccaaaaugaacagggaaguggcuacgccgcagaucucaaaagcacgcagaacgcuaucgacaagauaaccaauaaagugaacuccguuauugagaagaugaauacacaguuuacugccguggguaaggaguucaaccaccuggaaaaacggaucgagaauuuaaacaagaaagucgaugacggguuccuggauaucuggaccuacaaugcugaacuccuugugcuguuggagaacgaacgcacacuagacuaucaugauucuaauguaaagaaccuguacgagaaaguucgaagccaacucaagaacaaugccaaggagauuggcaacggauguuuugaguucuaucacaaaugcgacaauacuuguauggaaucagugaagaacggcaccuacgauuaucccaaauacagugaagaggcaaagcugaauagagaagagaucgacggggucaaacuugaguccacaaggauuuaucagauacuggccaucuacagcaccguggcuucuucauugguccucgugguuagucugggagcgauuagcuuuuggaugugcuccaacgguucuuuacagugccggaucuguaucuga

SEQ ID NO: 127659 - RNA, 1701 nt, Artificial Sequence
  derived and/or modified sequence opt3 from hemagglutinin__InfluenzaA__ADM23846
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaggagcucagggagcagcugucaagcgugaguuccuucgaacgguuugagaucuucccgaagacaucuagcuggcccaaucacgauuccaacaagggugucaccacggccuguccucaugcuggggcaaaaucauuuuauaagaaucugauauggcucgugaaaaagggaaacaguuacccaaaauuaagcaagucuuauaucaaugacaagggcaaagaaguacugguucuuuggggcauucaccaccccuccacuucagccgaucaacagagcuuguaccagaacgcugacgccuacguguucgucgggaccagucgcuauucuaagaaauuuaagccugagaucgcgauucgaccaaaagugcgugaucaggagggaagaaugaauuacuauuggacacugguggaacccggugacaagaucacuuucgaggcaaccggcaaccuagucguuccuagguacgccuuugcuauggaacggaacgccggguccggaauaauuaucagcgauacaccagugcaugacugcaauaccacgugucaaacuccgaaaggcgcaauuaacacaucgcuccccuuccagaauauccacccuaucaccauugguaagugcccaaaguauguaaaaucuacuaagcugcgccuugcuacagggcugagaaacgugcccuccauacagucaaggggauuguuuggcgccaucgcgggcuucauugaagggggauggaccgguauggucgacggcugguacggguaucaucaccagaaugaacaaggaaguggcuacgccgcagaucucaaaagcacgcagaacgcuaucgacaagauaaccaauaaagugaacuccguuauugagaagaugaauacacaguuuacugccguggguaaggaguucaaccaccuggaaaaacggaucgagaauuuaaacaagaaagucgaugacggguuccuggauaucuggaccuacaaugcugaacuccuugugcuguuggagaacgaacgcacacuagacuaucaugauucuaauguaaagaaccuguacgagaaaguucgaagccagcucaagaacaaugccaaggagauuggcaacggauguuuugaguucuaucacaaaugcgacaauacuuguauggaaucagugaagaacggcaccuacgauuauccuaaauacagugaagaggcaaagcugaauagagaagagaucgacggggucaaacuugaguccacaaggauuuaucaaauacuggccaucuacagcaccguggcuucuucauugguccucgugguuagucugggagcgauuagcuuuuggaugugcuccaacgguucuuuacagugccggaucuguaucuga

SEQ ID NO: 127660 - RNA, 1701 nt, Artificial Sequence
  derived and/or modified sequence opt3 from hemagglutinin__InfluenzaA__ADM23847
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaagaacucagggagcagcugucaagcgugaguuccuucgaacgguuugagaucuucccgaagacaucuagcuggcccaaucacgauuccaacaagggugucaccacggccuguccucaugcuggggcaaaaggauuuuauaagaaucugauauggcucgugaaaaagggcaacucauacccaaaauuaaguaagagcuauaucaaugacaagggcaaagaaguacugguucuuugggggauucaccaccaaucuacuuccgccgaucagcagucauuguaccagaacgcugacgccuacguguucgucggaaccagccgcuauaguaagaaauuuaagcccgagaucgcgauucgaccuaaagugcgugaucaagaggguagaaugaauuacuauuggacacugguggaaccaggcgacaagaucacuuucgaggcaaccgggaaccuagucguucccagguacgccuuugcuauggaacggaacgugggaucuggcauaauuaucuccgauacaccuguacaugacugcaauaccacgugucagacuccaaaaggugccauuaacacaagccucccguuccagaauauccaccccaucaccauugggaagugcccuaaguaugugaaaucgacuaagcugcgccuugcaacaggacugagaaacgucccaucuauacaguccaggggcuuguuuggcgcuaucgccggguucauugagggagguuggaccggcaugguggacgggugguacggauaucaucaccaaaaugaacagggcucagguuacgcggccgaucucaaaaguacgcagaacgcaaucgacaagauaaccaauaaaguuaacagcgugauugagaagaugaauacacaguuuacugcugucgggaaggaguucaaccaccuggaaaaacggaucgagaauuuaaacaagaaaguggaugacggcuuccuggauaucuggaccuacaaugccgaacuccuuguacuguuggagaacgaacgcacacuagacuaucaugauuccaauguuaagaaccuguacgagaaagugcgaucucaacucaagaacaaugcuaaggagauuggaaacggcuguuuugaguucuaucacaaaugcgacaauacuuguauggagagcgucaagaacgggaccuacgauuaucccaaauacucagaagaggccaagcugaauagagaagagaucgacggagugaaacuugagaguacaaggauuuaucagauacuggcaaucuacuccaccgucgccagcucuuuggugcucguugugucacugggugcuauuaguuuuuggaugugcagcaacggcuccuuacagugccggaucuguaucuga

SEQ ID NO: 127661 - RNA, 1701 nt, Artificial Sequence
  derived and/or modified sequence opt3 from hemagglutinin__InfluenzaA__ADM23849
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccaaucaacgagcgcugaucagcagaguuuguaccagaacgccgacgcguacguguucgucgggacuucucgcuauuccaagaaauuuaagcccgagauugcaauccgaccuaaagugcgugaucaagagggaagaaugaauuacuauuggacccugguggaaccaggugacaagauuacauucgaggccacuggcaaccuagucguucccagguacgcuuuugccauggaacggaacgcagggagcggaaucauaauuucggauaccccugugcaugacugcaauacaaccugucagacgccaaaaggcgcuaucaacacuucucucccguuccagaauauucaccccaucacaaucgguaagugcccuaaguauguaaaauccaccaagcugcgccuugccacugggcugagaaacgugccaucaauucagaguaggggauuguuuggcgcgauagccggcuucaucgaagggggauggacagguauggucgacggcugguacggguaucaucaccaaaaugaacagggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacaacucaagaacaaugcaaaggagaucggcaacggauguuuugaguucuaucacaaaugcgacaauacauguauggaaagugugaagaacggcacuuacgauuaucccaaauacuccgaagaggccaagcugaauagagaagagauugacggggucaaacuugagagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 127662 - RNA, 1701 nt, Artificial Sequence
  derived and/or modified sequence opt3 from hemagglutinin__InfluenzaA__ADM23851
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccaaucaacgagcgcugaucagcagaguuuguaccagaacgccgacgcguacguguucgucgggucuucccgcuauagcaaaaaguuuaaacccgagauugcaauccgaccuaaggugcgugaucaagaaggaagaaugaauuacuauuggacucugguggagccaggugacaaaauuaccuucgaagccacaggcaaccuagucguucccagguacgcuuuugccauggagcggaacgcagggucgggaaucauaauuucugauacuccugugcaugacugcaauaccacaugucagaccccaaagggcgcuaucaacacgucccucccguuccacaauauucaucccaucacuaucgguaaaugcccuaaguauguaaagucaacaaaacugcgccuugccaccgggcugagaaacgugccaaguauucagagcaggggauuguuuggcgcgauagccggcuucaucgaagggggauggacugguauggucgacggcugguacggguaucaccaccagaaugagcaaggauccggcuacgcagcugaucucaagucuacacagaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuaucccaaauacagcgaagaggccaagcugaauagagagaaaauugacggggucaaacuugaaucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 127663 - RNA, 1701 nt, Artificial Sequence
  derived and/or modified sequence opt3 from hemagglutinin__InfluenzaA__ADM23852
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagagagaaaauugacggggucaaacuugaaucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 127664 - RNA, 1701 nt, Artificial Sequence; identical to SEQ ID NO: 127663
  derived and/or modified sequence opt3 from hemagglutinin__InfluenzaA__ADM23853

SEQ ID NO: 127665 - RNA, 1701 nt, Artificial Sequence; identical to SEQ ID NO: 124927
  derived and/or modified sequence opt3 from hemagglutinin__InfluenzaA__ADM23855

SEQ ID NO: 127666 - RNA, 1701 nt, Artificial Sequence
  derived and/or modified sequence opt3 from hemagglutinin__InfluenzaA__ADM23856
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaagaacucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagcgcaaagaaguacuggugcuuuggggcauccaccaccaaucaacgagcgccgaucagcagaguuuguaccagaacgcugacgccuacgucuucgugggcacuucucgauauuccaagaaauuuaagcccgagauugcgauccguccuaaagugagagaucaagaggggaggaugaauuacuauuggacccuggucgaaccaggagacaagauuacauucgaggcaacugguaaccuaguugugccccgguacgccuuugcuauggaacgcaacgccggcagcgggaucauaauuucggauaccccuguacaugacugcaauacaaccugucagacgccaaaaggagcaaucaacacuucucucccguuccagaauauucaccccaucacaaucggcaagugcccuaaguaugugaaauccaccaagcugagacuugcuacuggucugaggaacgucccaucaauucagagucggggguuguuuggagccauagcgggcuucaucgagggcggguggacaggaaugguggacgguugguacggcuaucaucaccaaaaugaacaggggagcggauacgccgcagaucucaaauccacccagaacgcuauugacaagaucacgaauaaaguuaacucugugauagagaagaugaauacccaguuuacagccgucggcaaggaguucaaccaccuggaaaaacgcauugagaauuuaaacaagaaaguggaugacgguuuccuggauaucuggacuuacaaugcugaacuccuuguacuguuggagaacgaacgaacccuagacuaucaugauagcaauguuaagaaccuguacgagaaagugagaucacaacucaagaacaaugccaaggagaucgggaacggcuguuuugaguucuaucacaaaugcgacaauacauguauggagagugucaagaacggaacuuacgauuaucccaaauacuccgaagaggcaaagcugaauagggaagagauugacggcgugaaacuugagagcacccggaucuaucagauucuggccauauacucuacagucgcuucaaguuuggugcucguugugagccugggggcgaucuccuuuuggaugugcucuaacggaucguuacagugccguauuuguaucuga

SEQ ID NO: 127667 - RNA, 1701 nt, Artificial Sequence; identical to SEQ ID NO: 124685
  derived and/or modified sequence opt3 from hemagglutinin__InfluenzaA__ADM25945

SEQ ID NO: 127668 - RNA, 1701 nt, Artificial Sequence; identical to SEQ ID NO: 124927
  derived and/or modified sequence opt3 from hemagglutinin__InfluenzaA__ADM25948

SEQ ID NO: 127669 - RNA, 1701 nt, Artificial Sequence; identical to SEQ ID NO: 126714
  derived and/or modified sequence opt3 from hemagglutinin__InfluenzaA__ADM26264

SEQ ID NO: 127670 - RNA, 1701 nt, Artificial Sequence; identical to SEQ ID NO: 126714
  derived and/or modified sequence opt3 from hemagglutinin__InfluenzaA__ADM26265

SEQ ID NO: 127671 - RNA, 1701 nt, Artificial Sequence; identical to SEQ ID NO: 126714
  derived and/or modified sequence opt3 from hemagglutinin__InfluenzaA__ADM26266

SEQ ID NO: 127672 - RNA, 1701 nt, Artificial Sequence; identical to SEQ ID NO: 126714
  derived and/or modified sequence opt3 from hemagglutinin__InfluenzaA__ADM26267

SEQ ID NO: 127673 - RNA, 1701 nt, Artificial Sequence
  derived and/or modified sequence opt3 from hemagglutinin__InfluenzaA__ADM26268
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagagaaaaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaauccgugaaaaacggcaccuacgacuaucccaaguacagcgaagaggcaaaacugaagagagaggaaauugauggggucaaacuugagucuacaaggaucuaucaaauucuggccauauacucaaccguggcuaguagcuugguccucgugguuucccugggagcgaucucuuuuuggaugugcucgaaugguagcuuacagugccggauuuguaucuga

SEQ ID NO: 127674 - RNA, 1701 nt, Artificial Sequence
  derived and/or modified sequence opt3 from hemagglutinin__InfluenzaA__ADM26269
augaagaccauccuggugguccuccuuuacacauucacuacggccaacgcugacacccugugcauuggcuaucacgcaaauaacagcacagauacuguugacaccguguuggagaaaaauguaacagugacccauuccgucaacuuacuggaagauaagcacaaugggaaacuauguaagcucagaggaguggcgccccugcaucuugguaaaugcaacauagccggcuggauccuggggaauccugagugugaaucuuugucaacugcuaguagcugguccuacauuguugagacaucuucgucagacaacggaaccugcuauccaggcgauuuuaucgacuacgaagaacucagggagcagcugagcaguguguccucuuucgaacgguuugagauuuucccgaagacgagcuccuggcccaaucacgauucaaacaagggugucacugccgcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgcagaucaacagaguuuguaccagaacgccgacgcuuacguguucgucgggacaucucgcuauuccaagaaauuuaagccugagauugccauccgaccaaaagugcgugagcaggaaggaagaaugaauuacuauuggacucugguggagcccggugauaagauuaccuucgaagcgacaggcaaccuagucguuccuagguacgcauuugccauggagcggaacgcugggagcggaaucauaauuucggacaccccagugcaugauugcaauacgacuugucaaacaccgaaaggcgccaucaacaccucucuccccuuccagaauauucacuccaucacuaucgguaagugcccuaaguauguaaaaucaacaaagcugcgccuugcaaccgggcugagaaacgugccaaguauucagagcaggggauuguuuggcgcuauagccggcuucaucgaagggggauggacggguauggucgacggcugguacggguaucaucaccagaaugagcaaggauccggcuacgcggccgaccucaaaucuacccagaacgcaauugaugagaucacaaauaaggugaacagcguuauagagaaaaugaauacucaguuuaccgcuguggguaaggaguucaaccaccuggaaaagcggauugagaauuuaaacaaaaaggucgacgauggguuccuggacaucuggacauacaaugccgaacuccuugugcuguuggagaacgagcgcacucuagauuaucaugacucaaauguuaaaaaccuguacgaaaagguacgaagucagcucaaaaacaaugcuaaggagaucggcaacggauguuuugaguucuaucacaagugcgauaauaccuguauggaauccgugaaaaacggcacauacgacuaucccaaguacagcgaagaggccaaacugaagagagaggaaauugauggggucaaacuugagucuaccaggaucuaucaaauucuggcaauauacucaacuguggccaguagcuugguccucgugguuucccugggagcuaucucuuuuuggaugugcucgaaugguagcuuacagugccggauuuguaucuga

SEQ ID NO: 127675 - RNA, 1701 nt, Artificial Sequence
  derived and/or modified sequence opt3 from hemagglutinin__InfluenzaA__ADM26270
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucggucgcugcccuaaguauguaaagucaacuaaacugagacuugcuacagggcugaggaacgugccaaguauucagagccggggauuguuuggcgccauagcgggcuucaucgaagggggauggaccgguauggucgacggcugguacggguaucaucaccagaaugagcaaggauccggcuacgccgcagaccucaagucuacgcagaacgcuauugaugagaucaccaauaaagugaacagcguuauagaaaagaugaauacacaguuuacugccguggguaaagaguucaaccaccuggaaaagcgcauugagaauuuaaacaagaaagucgacgauggguuccuggacaucuggaccuacaaugcugaacuccuugugcuguuggagaacgagcgaacacuagaucaucacgacucaaauguaaagaaccuguaugaaaaaguuagaagucagcucaagaacaaugccaaagagaucggcaacggauguuuugaguucuaccauaagugcgauaauacuuguauggaguccgugaagaacggcaccuaugacuaccccaaauauagcgaagaggcaaagcugaauagggaggaaauugauggggucaaacuugagucuacacggaucuaccaaauucuggccauauauucaaccguggcuaguagcuugguccucgugguuucccugggagcgaucucuuuuuggaugugcucgaacgguagcuuacagugccguauuuguaucuga

SEQ ID NO: 127676 - RNA, 1701 nt, Artificial Sequence; identical to SEQ ID NO: 126714
  derived and/or modified sequence opt3 from hemagglutinin__InfluenzaA__ADM26271

SEQ ID NO: 127677 - RNA, 1701 nt, Artificial Sequence
  derived and/or modified sequence opt3 from hemagglutinin__InfluenzaA__ADM26272
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucggucgcugcccuaaguauguaaagucaacuaaacugagacuugcuacagggcugaggaacgugccaaguauucagagccggggauuguuuggcgccauagcgggcuucaucgaagggggauggaccgguauggucgacggcugguacggguaucaucaccagaaugagcaaggauccggcuacgccgcagaccucaagucuacgcagaacgcuauugaugagaucaccaauaaagugaacagcguuauagaaaagaugaauacacaguuuacugccguggguaaagaguucaaccaccuggaaaagcgcauugagaauuuaaacaagaaagucgacgauggguuccuggacaucuggaccuacaaugcugaacuccuugugcuguuggagaacgagcgaacacuagauuaucaugacucaaauguaaagaaccuguacgaaaaaguuagaagucagcucaagaacaaugccaaagagaucggcaacggauguuuugaguucuaucacaagugcgauaauacuuguauggaguccgugaagaacggcaccuacgacuaucccaaauacagcgaagaggcaaagcugaauagggaggaaauugauggggucaaacuugagucuacacggaucuaucaaauucuggccauauacucaaccguggcuaguagcuugguccucgugguuucccugggagcgaucucuuuuuggaugugcucgaacgguagcuuacagugccguauuuguaucuga

SEQ ID NO: 127678 - RNA, 1701 nt, Artificial Sequence
  derived and/or modified sequence opt3 from hemagglutinin__InfluenzaA__ADM26274
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagaaaagaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguaaaagaucuguacgaaaagguucgaagucagcucaaaaacaacgccaaggagaucggcaauggauguuuugaguucuaucacaagugcgacaacacuuguauggaguccgugaaaaauggcaccuacgauuaucccaaguacagcgaagaggcaaaacugaacagagaggaaauugacggggucaaacuugagucuacaaggaucuaucaaauucuggccauauacucaaccguggcuaguagcuugguccucgugguuucccugggagcgaucucuuuuuggaugugcucgaaugguagcuuacagugccggauuuguaucuga

SEQ ID NO: 127679 - RNA, 1701 nt, Artificial Sequence; identical to SEQ ID NO: 126714
  derived and/or modified sequence opt3 from hemagglutinin__InfluenzaA__ADM26276

SEQ ID NO: 127680 - RNA, 1701 nt, Artificial Sequence
  derived and/or modified sequence opt3 from hemagglutinin__InfluenzaA__ADM26277
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagaaaagaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaguccgugaaaaacggcaccuacgacuaucccaaguacagcgaagaggcaaaacugaauagagaggaaauugauggggucaaacuugagucuacaaggaucuaucaaauucuggccauauacucaaccguggcuaguagcuugguccucaucgugucccugggagcgauuucuuuuuggaugugcucgaacgguagcuuacagugccggaucuguaucuga

SEQ ID NO: 127681 - RNA, 1701 nt, Artificial Sequence
  derived and/or modified sequence opt3 from hemagglutinin__InfluenzaA__ADM26278
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacgugucugucgggaccucccgcuauagcaagaaauucaagccugagauugcgauccgaccaaaagugcgugagcaggaaggaagaaugaauuacuauuggacacugguggagcccggugauaagauuacuuuugaagcaaccggcaaccuagucguuccuagguucgccuuugcuauggagcggaacgccgggucgggaaucauaauuucugacacaccagugcaugauugcaauaccacgugucaaacuccgaaaggcgcaaucaacacaucccuccccuuccagaauauucacucaaucaccaucgguaagugcccuaaguacguaaaaaguacuaagcugcgccuugcuacagggcugagaaacgugccaagcauucaguccaggggauuguuuggcgccauagcgggcuucaucgaagggggauggaccgguauggucgacggcugguauggguaccaucaccagaaugagcaaggaucuggcuaugccgcagaccucaaaagcacgcagaacgcuauugaugagaucaccaauaaggugaacucaguuauagagaaaaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaccaugacaguaauguuaaaaaccuguaugaaaagguacgaucccagcucaaaaacaaugccaaggagaucggcaacggauguuuugaguucuaccacaagugcgauaauacuuguauggaaagcgugaaaaacggcaccuaugacuaccccaaguauucugaagaggcaaaacugaagagagaggaaauugauggggucaaacuugagucaacaaggaucuaccaaauucuggccauauauaguaccguggcuagcuccuugguccucgugguuucucugggagcgaucucguuuuggaugugcagcaaugguuccuuacagugccggauuuguaucuga

SEQ ID NO: 127682 - RNA, 1701 nt, Artificial Sequence
  derived and/or modified sequence opt3 from hemagglutinin__InfluenzaA__ADM26279
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcguggacaggaggguagaaugaauuacuauuggacacugguggaacccggcgauaagauuacuuucgaggcaaccgggaaccuagucguuccuagguacgccuuugcuauggaacggaacgccggaagcggcaucauaauuucggacacaccagugcaugauugcaauaccacgugucaaacuccgaaaggugcaaucaacacaucucuccccuuccagaauauucacuccaucaccaucgggaagugcccuaaguauguaaaaucaacuaagcugcgccuugcuacaggacugagaaacgugccaaguauucagagcaggggcuuguuuggcgccauagcgggguucaucgagggagguuggaccggcauggucgacgggugguacggauaucaucaccagaaugaacaaggcuccgguuacgccgcagaccucaaaucuacgcagaacgcuauugaugagaucaccaauaaggugaacagcguuauagagaaaaugaauacacaguuuacugccguggggaaggaguucaaccaccuggagaagcggauugaaaauuuaaacaaaaaggucgacgauggcuuccuggacaucuggaccuacaaugcugagcuccuugugcuguuggaaaacgagcgcacacuagauuaucaugacucaaauguaaagaaccuguacgagaagguucgaagucagcucaaaaacaaugccaaggaaaucggaaacggcuguuuugaguucuaucacaagugcgauaauacuuguauggaauccgugaaaaacgggaccuacgacuaucccaaguacagcgaggaagcaaaacugaauagagaggagauugauggagucaaacuugaaucuacaaggaucuaucaaauucuggccauauacucaaccguggcuaguagcuugguccucgugguuucccugggugcgaucucuuuuuggaugugcucgaacggcagcuuacagugccggauuuguaucuga

SEQ ID NO: 127683 - RNA, 1701 nt, Artificial Sequence; identical to SEQ ID NO: 126714
  derived and/or modified sequence opt3 from hemagglutinin__InfluenzaA__ADM26280

SEQ ID NO: 127684 - RNA, 1701 nt, Artificial Sequence
  derived and/or modified sequence opt3 from hemagglutinin__InfluenzaA__ADM26281
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccaguccauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacaagaucacgaacaaagugaauagcguuauagagaagaugaacacccaguuuacagcuguggguaaggaguucaaucaccuggaacggcgcauugagaacuuaaauaaaaaggucgaugacggguuccuggauaucuggacuuacaacgccgaacuccuugugcuguuggagaaugaacgaacccuagacuaucaugauucaaacguaaagaaucuguacgagaagguuagaagucagcucaaaaacaacgcaaaggagaucggcaauggauguuuugaguucuaucacaagugcgacaacacauguauggaauccgugaaaaauggcacuuacgauuauccuaaguacagcgaagaggccaaacugaacagggaagagauugacggggucaaacuugagucuacccggguguaucaaauccuggcuauuuacucaacagucgcgaguagcuuggugcucguugugucccugggagcaauaucuuuuuggaugugcucgaaugguagcuuacagugccguaucuguauuuga

SEQ ID NO: 127685 - RNA, 1701 nt, Artificial Sequence
  derived and/or modified sequence opt3 from hemagglutinin__InfluenzaA__ADM26282
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagagaaaaugaauacacaguuuacugccguggguaaggaguucaaccaccuggaacggcgcauugagaauuuaaacaagaaagucgacgauggguuccuggacaucuggaccuacaaugcugaacuccuugugcuguuggagaacgagcgaacacuagauuaucaugacucaaauguaaagaaccuguacgaaaaaguuagaagucagcucaagaacaaugccaaagagaucggcaacggauguuuugaguucuaucacaagugcgauaauacuuguauggaauccgugaagaacggcaccuacgacuaucccaaauacagcgaagaggcaaagcugaauagggaggaaauugauggggucaaacuugagucuacacggaucuaucaaauucuggccauauacucaaccguggcuaguagcuugguccucgugguuucccugggagcgaucucuuuuuggaugugcucgaacgguagcuuacagugccguauuuguaucuga

SEQ ID NO: 127686 - RNA, 1701 nt, Artificial Sequence
  derived and/or modified sequence opt3 from hemagglutinin__InfluenzaA__ADM26283
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacuccaucaccaucgguaagugcccuaaguauguaaaaucaacuaagcugcgccuugcuacagggcugagaaacgugccaaguauucagagcaggggauuguuuggcgccauagcgggcuucaucgaagggggauggaccgguauggucgacggcugguacggguaucaucaccagaaugagcaaggauccggcuacgccgcagaccucaaaucuacgcagaacgcuauugaugagaucaccaauaaggugaacagcguuauagagaaaaugaauacacaguuuacugccguggguaaggaguucaaccaccuggaaaagcggauugagaauuuaaacaaaaaggucgacgauggguuccuggacaucuggaccuacaaugcugaacuccuugugcuguuggagaacgagcgcacacuagauuaucaugacucaaauguuaaaaaccuguacgaaaagguacgaagucagcucaaaaacaaugccaaggagaucggcaacggauguuuugaguucuaucacaagugcgauaauacuuguauggaauccgugaaaaacggcaccuacgacuaucccaaguacagcgaagaggcaaaacugaauagagagaagauugauggggucaaacuugaaucuacaaggaucuaucaaauucuggccauauacucaaccguggcuaguagcuugguccucgugguuucccugggagcgaucucuuuuuggaugugcucgaacgguagcuuacagugccggauuuguaucuga

SEQ ID NO: 127687 - RNA, 1701 nt, Artificial Sequence; identical to SEQ ID NO: 126714
  derived and/or modified sequence opt3 from hemagglutinin__InfluenzaA__ADM26284

SEQ ID NO: 127688 - RNA, 1701 nt, Artificial Sequence; identical to SEQ ID NO: 126714
  derived and/or modified sequence opt3 from hemagglutinin__InfluenzaA__ADM26285

SEQ ID NO: 127689 - RNA, 1701 nt, Artificial Sequence
  derived and/or modified sequence opt3 from hemagglutinin__InfluenzaA__ADM26784
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaugcggcgcuccaacaauucauuuuucagucgacugaacuggcucacucauuuaaaguuuaaguauccagcacugaaugugaccaugcccaacaacgagcaguucgacaaacuuuacaucuggggaguccaccauccuggcacagauaaugaccagaucuuuuuguaugcccaagcuagcggccguauuacugugucuaccaagagaucccagcagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugucaaccgaauuacauauggugcauguccuagauacgugaaacaaaauacccugaagcuggccacugggaugaggaacgugccagagaaacagacacggggaaucuucggcgcuaucgccggcuuuauugaaaaugggugggagggaauggucgaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguugaagggaggauucaagaccuggagaaguacguggaggauaccaaaaucgacuuauggucuuauaaugccgaacugcucguagcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacguguaccgcgacgaggcucugaacaauagauuccagauuaaaggagucgaacucaagagugguuacaaagauuggauccuguggauuuccuuugccaucagcugcuuccuucuguguguggcauugcucggcuuuauaaugugggccugccaaaaggggaacaucagguguaauauuugcaucuga

SEQ ID NO: 127690 - RNA, 1701 nt, Artificial Sequence; identical to SEQ ID NO: 124450
  derived and/or modified sequence opt3 from hemagglutinin__InfluenzaA__ADM26795

SEQ ID NO: 127691 - RNA, 1701 nt, Artificial Sequence
  derived and/or modified sequence opt3 from hemagglutinin__InfluenzaA__ADM26817
augaagaccacaaucgcccugagccacauucucugccuuguguucgcucagaaacugcccggcaacgacaauuccacugcaacguuguguuuagggcaucacgccgucccuaacggaaccauaguuaagacaaucacuaaugaucaaauugaggugaccaacgcgacagaacugguacagucuucaagugcuggugagaucugcgacagcccacaucagauucuagauggcgaaaauuguacccucaucgacgcccugcuuggggauccgcagugcgacggauuucaaaacaaaaagugggaucuguucguggagagaaggcgggcauacuccaauuguuaucccuacgacgucccugauuaugccucuuugcgcucgcucguggcuucaagcggcacucuggaauuuaacaaugagaguuucaacuggacagguguuacccagaaugggacguccucugcaugcauacgacguagcaacaauuccuuuuucucaagacugaacuggcucacucacuuaaauuuuaaauacccagcccugaacgugaccaugcccaacaaugagcaguucgacaaguuguauaucuggggaguccaucacccuggcacagauaaggaccagauuuuucuuuacgcucaagccaguggcaggaucacugugagcaccaaacggucucagcaggcgguaauuccaaacaucgggucccgccccagaguuaggaauauaccuucacggauuagcaucuauuggacaauugugaagccaggagauauccugcuaaucaacaguaccgguaaucucauugcaccgcgcggcuacuucaaaauacgaucugggaaguccagcaucaugagaucggacgcccccauuggaaaauguaacucugaaugcaucacgccuaauggcuccauaccaaacgacaagcccuuucagaaugucaacaggauuacuuacggugcuuguccucgguaugugaagcaaucaacacugaaacuugccaccgggaugcguaaugugccagagaagcagacucgcggaaucuucggcgcaaucgcuggcuuuauugaaaacgggugggagggaauggucgaugguugguacggcuucagacaccagaauagugaggggaggggacaagccgcggaccugaaaagcacacaggccgcaaucgaucagauuaacggcaaguugaaucggcucauagguaaaaccaacgaaaaguuccaucagaucgagaaagaauuuuccgagguugaagggcgcauucaagaccuggagaaguauguggaggauacgaagaucgacuuauggucuuacaacgcugaacugcucguagcccuugagaaucagcacaccaucgaucugacagacagcgaaaugaacaaauuguucgagaagacuaaaaagcagcuacgagaaaaugcugaggauaugggcaacggaugcuuuaaaauuuaucauaagugugacaaugccugcauaggcucaaucagaaacgggaccuacgaucacgacguguauagggacgaggcacugaauaaccgguuccagauuaagggagucgaacucaaaagugguuacaaggauuggauccuguggauuuccuuugccaucagcugcuuccuucuguguguggcuuugcucggcuuuauaaugugggcgugccaaaaagggaauauccgcuguaacauuugcaucuga

SEQ ID NO: 127692 - RNA, 1704 nt, Artificial Sequence
  derived and/or modified sequence opt3 from hemagglutinin__InfluenzaA__ADM31424
auggagaagaucgugcuccuguucaccacaauuagccuugucaaauccgaccacauaugcaucggcuaccaugccaacaauucuacugaacagguugauacgauuauggagaagaacgugaccguaacacacgcucaagacauccuggaaaagacucauaaugggaaguugugugauuuaaacggagugaaaccccugauucuaaaggacugcucagucgcagguuggcuccugggcaauccucuuugugaugaguuuaucaacgugccagaauggaguuauauaguugagaaggccaauccggcgaacgaccugugcuaccccgggaauuucaacgauuaugaggaauugaaacaccuccugagcagaaucaaucauuuugagaagauucagaucauuccuaaagacuccuggucugaucacgaggcuucgcugggagugucagccgcauguagcuaccagggcaacaguuccuucuuuaggaaugucguguggcucaucaagaaagacaacgccuauccaaccauaaagaaggauuacaauaacacaaaccaggaagacuuacugguacuuugggguauucaccaucccaaugaugaggcugaacaaacccgguuguaucagaacccuacuacauacaucucuauugggaccagcacgcugaaucagcgccuaguuccaaaaaucgcaacucgauccaagaucaacggacagucaggccguauugacuucuuuuggaccauacucaaacccaaugacgccauccacuucgagaguaacggcaauuuuauugcuccugaauacgccuauaagaucgugaaaaagggggauagcacaauaaugaaaucugaggucgaauacggaaacugcaauacuagaugucaaaccccaauuggugcgaucaacuccucaaugccguuccauaauauccacccccugacaauuggcgagugcccuaaguaugugaaaagcaacaaacuugugcuggcaaccggguugaggaauaguccacagcgggagcgcagaaggaagcggggacucuuuggcgccaucgcugguuucauugaagggggauggcagggcauggucgacggcugguacggguaucaccauucuaacgagcagggauccgguuacgccgcagauaaagaaagcacgcaaaaggcuauagacggcguuacuaauaaagugaacucgaucauugauaagaugaacacacaguuugaggccguagggcgcgaguucaauaaccuggaacgaagaaucgagaauuuaaacaagaaaauggaagacggauuccuggauguguggaccuauaaugcggagcuccuuguccugauggaaaacgagaggacuuuggacuuucacgauucuaaugugaagaaccuauacgacaaaguucggcugcagcucaaggauaaugccaaagaacugggcaacgguuguuucgaguuuuaccauaagugcaauaacgaguguauggaauccgugcguaaugggacauaugacuacccccaauauucagaggaagcacgccuuaagagagaggagaucaguggcgucaaacuggaaagcauuggaauauaccagaucuuguccauuuauucuaccguggcuagcucacucguacuggccaucaugauggcuggcuuaagucuguggaugugcuccaacgggagccuacagugcaggauuuguaucuga

SEQ ID NO: 127693 - RNA, 1701 nt, Artificial Sequence; identical to SEQ ID NO: 127286
  derived and/or modified sequence opt3 from hemagglutinin__InfluenzaA__ADM31478

SEQ ID NO: 127694 - RNA, 1701 nt, Artificial Sequence
  derived and/or modified sequence opt3 from hemagglutinin__InfluenzaA__ADM31488
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuuccaaguauagcaaaaaguuuaaaccugagaucgcaauucgcccaaaggugcgagaucaggagggacguaugaauuacuauuggacuuugguggaacccggugacaaaaucaccuucgaggccacaggcaaccuggucguuccuagauacgcuuuugccauggaaaggaacgcagggucgggaauaauuaucucugauacuccagugcaugacugcaauaccacaugucaaaccccgaagggcgcuauuaacacgucccuacccuuccagaauauccacccuaucacuauugguaagugcccaaaauauguaaagucaacaaaacuccggcuggccaccgggcuucgcaacgugcccaguauacagagcagaggacuguuuggcgcgaucgccggcuucauugaagggggauggacugguauggucgacggcugguacggguaucaucaccagaaugaacaaggauccggcuacgcagcugauuugaagucuacacagaacgccaucgacgagauaaccaauaaagugaacagcguuauugagaagaugaauacgcaguuuaccgcuguggguaaggaguucaaccaccucgagaaaaggaucgaaaaucugaacaagaaagucgaugacggguucuuagauaucuggacauacaaugccgagcugcucgugcuucuggaaaacgagcggacuuuggacuaucaugauucaaauguaaagaaccuauacgagaaaguucgcagucagcugaagaacaaugcaaaggaagugggcaacggauguuuugaguucuaucacaaaugcgacaauaccuguauggaauccgucaagaacggcacauacgauuauccuaaauacagcgaggaagccaagcucaaucgagaggagauugacggggugaaacuggaaucuacuagaaucuaucaaauucuugcuauauacucaaccgcggcaaguagccuggucuuggugguuucccucggagccaucucuuuuuggaugugcucgaacgguagccugcagugcaggauuuguaucuga

SEQ ID NO: 127695 - RNA, 1701 nt, Artificial Sequence
  derived and/or modified sequence opt3 from hemagglutinin__InfluenzaA__ADM31498
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggugaagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagcacgccauugacgaaaucacgaacaaaguuaauucugugauagagaagaugaacacccaguuuacagcuguggguaaggaguucaaucaucuggaaaaacggauugagaacuuaaauaagaaagucgaugacggguuccuggauaucuggacuuacaacgccgaacuccuugugcuguuggagaaugaacgcacccuagacuaucacgauagcaacguaaagaaucuguacgagaaaguucgaucacagcucaagaacaacgcaaaggagaucggcaauggauguuuugaguucuaucauaaaugcgacaacacauguauggagagugugaagaauggcacuuacgauuauccuaaauacuccgaagaggccaagcugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127696 - RNA, 1701 nt, Artificial Sequence
  derived and/or modified sequence opt3 from hemagglutinin__InfluenzaA__ADM31508
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacacgcagcuggcccaaucacgauuccaacaagggugucaccgccgcuuguccucaugcaggggccaaaucauuuuauaagagucugaucuggcucgugaaaaagggaaauagcuacccaaaauuaucuaaguccuauauaaacgacaagggcaaagaaguacugguucuuuggggcauccaccaccccucaacgagcgcugaucaacagaguuuguaccagaaugccgacgcguacguguucgucgggacuucucgauauuccaagaaauuuaagccugagauugcaauccguccaaaagugagagaucaggagggaaggaugaacuacuauuggacccugguggaacccggugacaagauuacauucgaggccacuggcaaucuagucguuccucgguacgcuuuugccauggaacgcaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugagacuugccacugggcugaggaaugugcccucaauucagagucggggauuguuuggcgcgauagccggcuucaucgaagggggauggacagguauggucgacggcugguacggguaucaucaccagaacgaacaaggaagcggcuacgcagcugaucucaaauccacccagcacgccauugacgagaucacgaauaaggugaacucuguuauagagaaaaugaauacccaguuuacagcuguggguaaggaguucaaccaucuggaaaagcgcauugaaaauuuaaacaaaaaggucgaugacggguuccuggauaucuggacuuacaaugccgagcuccuugugcuguuggaaaacgagcgaacccuagacuaucacgauagcaauguaaagaaccuguacgagaagguuagaucacagcucaaaaauaacgcaaaggaaaucggcaacggauguuuugaguucuaucauaagugcgacaauacauguauggaaagugugaaaaacggcacuuacgauuauccuaaguacuccgaggaagccaaacugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 127697 - RNA, 1701 nt, Artificial Sequence
  derived and/or modified sequence opt3 from hemagglutinin__InfluenzaA__ADM31518
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauguaaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacauccccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127698 - RNA, 1701 nt, Artificial Sequence
  derived and/or modified sequence opt3 from hemagglutinin__InfluenzaA__ADM31528
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacaagauuacgaauaaagugaacucuguuaucgagaagaugaauacccaguuuacagcuguggguaaggaguucaaccaccuggaaaaacggauagagaauuuaaacaagaaagucgaugacggguuccuggauauuuggacuuacaaugccgaacuccuugugcuguuggagaacgaacgcacccuagacuaucaugauagcaauguaaagaaccuguacgagaaaguucgaucacagcucaagaacaaugcaaaggaggugggcaacggauguuuugaguucuaucacaaaugcgacaauacauguauggaaagugucaagaacggcacuuacgauuauccuaaauacuccgaagaggccaagcugaauagagaagagaucgacggggugaaacuugagagcaccaggaucuaucaaauucuggcuaucuacucuacagucgcgucaaguuuggugcucguugugagccugggagcaauuuccuuuuggaugugcucuaacgguucguuacagugccggauauguaucuga

SEQ ID NO: 127699 - RNA, 1701 nt, Artificial Sequence
  derived and/or modified sequence opt3 from hemagglutinin__InfluenzaA__ADM31538
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaauauucccucaauacagaguaggggauuguuuggcgcgaucgccggcuucauugaagggggauggacagguaugguggauggcugguacggguaucaucaccagaacgaacaaggaagcggcuacgcagcugaccucaaauccacccagaaugccaucgauaagauaacgaacaaagucaauucugugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaucuguacgagaaaguacgaucacagcucaagaacaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127700 - RNA, 1701 nt, Artificial Sequence
  derived and/or modified sequence opt3 from hemagglutinin__InfluenzaA__ADM31548
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagguggcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacauccccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 127701 - RNA, 1701 nt, Artificial Sequence
  derived and/or modified sequence opt3 from hemagglutinin__InfluenzaA__ADM31558
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuagaaacggcuguuuugaguucuaucacaaaugcgacaauacauguauggaaaguguuaagaacggaacuuacgauuauccuaaauacuccgaagaggccaagcugaauagggaagagaucgacggcgugaaacuugagagcacccggauuuaucaaauacuggcuaucuacucuacagucgcgucaaguuuggugcucgucgugagccugggggcaauuuccuuuuggaugugcucuaacggaucguuacagugccguaucuguaucuga

SEQ ID NO: 127702 - RNA, 1701 nt, Artificial Sequence; identical to SEQ ID NO: 126282
  derived and/or modified sequence opt3 from hemagglutinin__InfluenzaA__ADM31568

SEQ ID NO: 127703 - RNA, 1701 nt, Artificial Sequence; identical to SEQ ID NO: 124685
  derived and/or modified sequence opt3 from hemagglutinin__InfluenzaA__ADM31578

SEQ ID NO: 127704 - RNA, 1701 nt, Artificial Sequence
  derived and/or modified sequence opt3 from hemagglutinin__InfluenzaA__ADM31588
augaaggccauccuggugguccuccuuuacaccuucgcuacagcaaacgccgacacucugugcauuggcuaucacgcgaauaacagcacggauaccguugacacaauauuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagauguucccgaagacaagcuccuggcccaaucacgauucaaacaagggugugaccgccgcuuguccucaugcaggggccaaaaguuuuuauaagaaucugaucuggcucgucaaaaagggaaacagcuacccaaaauuaaauaagucuuauauaaacgacaagggcaaagaagugcugguacuuuggggcauccaccaccccuccacgucagcugaucaacagagcuuguaccagaaugccgacgcguacguuuucguggggacuagccgcuauucuaagaaauuuaagaccgagauugcaauccgaccuaaaguccgugaucaggagggaagaaugaacuacuauuggacacugguggaaccaggugacaagauuacuuucgaggccaccggcaaccuagugguccccagguacgcuuuugccauggaacggaaugcaggguccggaaucauaauuagcgauacaccuguucaugacugcaacaccacgugucaaacuccaaaaggcgcuaucaauacaucgcucccguuccagaacauucaccccaucaccaucgguaagugcccuaaguaugugaaaucuacuaagcugcgccuugccacagggcugagaaauguaccauccauucagucaaggggauuguuuggcgcgauagccggcuucaucgaagggggauggaccgguaugguggacggcugguacggguaucaucaccagaacgaacaaggaaguggcuacgcagcugaucucaaaagcacgcagaaugccauugacgagaucaccaacaaggucaauuccgugauagagaaaaugaacacacaguuuacugcuguugguaaggaguucaaucaccuggaaaagcggauugaaaacuuaaauaaaaagguggaugacggguuccuggauaucuggaccuacaacgccgagcuccuuguccuguuggaaaaugagcgcacacuagacuaucaugauucuaacgugaaaaaccuguacgagaagguacgaagccagcucaaaaauaacgcaaaggaaguuggcaauggauguuuugaguucuaucacaagugcgacaacacuuguauggaaucagugaaaaauggcaccuacgauuaucccaaguacagugaggaagccaaacugaacagagaggagaucgacggggucaaacuugaauccacaaggauuuaucaaauccuggcuauuuacagcaccguggcgucuucauugguccucgugguuagucugggagcaauaaguuuuuggaugugcuccaaugguucuuuacagugccggaucuguauuuga

SEQ ID NO: 127705 - RNA, 1701 nt, Artificial Sequence
  derived and/or modified sequence opt3 from hemagglutinin__InfluenzaA__ADM31598
augaacgccauccuggugguccuccuuuacaccuucgcuacagcaaaugccgacacucugugcauuggcuaucacgcgaacaauagcacggauaccguugacacauuguuagagaagaacgugacuguaacccauuccgugaaucugcuagaagauaaacacaacgggaagcucuguaaacugagaggagucgcuccccuucaucuggguaagugcgacauagccggcuggaucuuggggaauccugagugugaaucucucucaacagcaaguagcugguccuacauuguggagaccucuucgucagauaacggaacuugcuauccaggcgacuuuaucgauuacgaggagcugagggagcagcugagcaguguuuccucuuucgaacgguuugagauuuucccgaaaacaagcuccuggcccgaccacgauucaaauaagggugugaccgccgcuuguccucaugcaggggccaagaguuuuuauaaaaaccucaucugguuagucaagaaaggaaauagcuacccaaagcugucuaaauccuauauaaacgacaagggcaaggaagugcuuguauuguggggcauccaccaccccucaacgagcgcugaucaacagagucuguaccagaaugccgacgcguacguuuucguggggacuucucgcuauuccaaaaaguuuaaaccugagauugcaauccgaccaaagguccgugaucaggagggaagaaugaacuaccauuggacccuaguggaacccggugacaaaauuacauucgaggccacuggcaaucucguggucccuagguaugcuuuugccauggaacggaacgcagggagcggaaucauaauuucggacgcuccaguucacgauugcaacaccacaugucaaaccccgaagggcgccaucaauacgucucugcccuuccagaacauucauccuaucacuaucgguaaaugcccaaaguacgugaaguccacaaaacuucgccuggcgaccggguugagaaauguacccucaauucagaguaggggacucuuuggcgccauagcaggcuucaucgaagggggauggacugguaugguggacggcugguauggguaccaccaccagaacgaacaaggaagcggcuaugcugccgaucugaaguccacacagaaugcuauugacgagaucaccaacaaaauaaauucugucauugagaagaugaacacgcaguuuaccgccguggguaaagaguucaaucauuuagaaaagcggaucgaaaaccugaauaagaaaguugaugacggguuccucgauaucuggacauacaacgcagagcuucugguguugcuagaaaaugagcgcacucuggacuaccacgauagcaacgucaagaaucucuaugagaaagugcgaucacagcugaagaacaacgccaaagaaauuggcaauggauguuuugaguucuaccauaagugcgacaacaccuguauggaaaguguaaagaauggcacauaugauuacccuaaauauuccgaggaagcuaaacuuaacagagaggagaucgacgggguuaagcuggaaagcacuaggauuuaccaaauauuggcgaucuauucuaccguggcaucaagucucguccugguggucagcuuaggagccauuuccuuuuggaugugcucuaaugguucgcugcagugccggaucuguaucuga

SEQ ID NO: 127706 - RNA, 1701 nt, Artificial Sequence
  derived and/or modified sequence opt3 from hemagglutinin__InfluenzaA__ADM31608
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagggcaaagaaguacuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacaagaucacgaauaaaguuaacucugugauagagaagaugaauacccaguuuacagccgucgguaaggaguucaaccaccuggaaaaacggauugagaauuuaaacaagaaaguggaugacggguuccuggauaucuggacuuacaaugcugaacuccuuguacuguuggagaacgaacgcacccuagacuaucaugauagcaauguuaagaaccuguacgagaaagugcgaucacagcucaagaacaaugccaaggagaucggcaacggauguuuugaguucuaucacaaaugcgacaauacauguauggaaagugucaagaacggcacuuacgauuauccuaaauacuccgaagaggcaaagcugaauagagaagagauugacggggugaaacuugagagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 127707 - RNA, 1701 nt, Artificial Sequence; identical to SEQ ID NO: 126237
  derived and/or modified sequence opt3 from hemagglutinin__InfluenzaA__ADM31618

SEQ ID NO: 127708 - RNA, 1701 nt, Artificial Sequence; identical to SEQ ID NO: 125849
  derived and/or modified sequence opt3 from hemagglutinin__InfluenzaA__ADM31628

SEQ ID NO: 127709 - RNA, 1701 nt, Artificial Sequence; identical to SEQ ID NO: 127588
  derived and/or modified sequence opt3 from hemagglutinin__InfluenzaA__ADM31638

SEQ ID NO: 127710 - RNA, 1701 nt, Artificial Sequence; identical to SEQ ID NO: 126105
  derived and/or modified sequence opt3 from hemagglutinin__InfluenzaA__ADM31648

SEQ ID NO: 127711 - RNA, 1701 nt, Artificial Sequence; identical to SEQ ID NO: 126852
  derived and/or modified sequence opt3 from hemagglutinin__InfluenzaA__ADM31658

SEQ ID NO: 127712 - RNA, 1701 nt, Artificial Sequence; identical to SEQ ID NO: 126105
  derived and/or modified sequence opt3 from hemagglutinin__InfluenzaA__ADM31668

SEQ ID NO: 127713 - RNA, 1701 nt, Artificial Sequence; identical to SEQ ID NO: 124685
  derived and/or modified sequence opt3 from hemagglutinin__InfluenzaA__ADM31688

SEQ ID NO: 127714 - RNA, 1701 nt, Artificial Sequence
  derived and/or modified sequence opt3 from hemagglutinin__InfluenzaA__ADM31698
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuugauucucguggucagccugggagcaaucuccuuuuggaugugcucuaacgguucguuacagugccggaucuguauuuga

SEQ ID NO: 127715 - RNA, 1701 nt, Artificial Sequence; identical to SEQ ID NO: 127590
  derived and/or modified sequence opt3 from hemagglutinin__InfluenzaA__ADM31708

SEQ ID NO: 127716 - RNA, 1701 nt, Artificial Sequence
  derived and/or modified sequence opt3 from hemagglutinin__InfluenzaA__ADM31718
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 127717 - RNA, 1701 nt, Artificial Sequence
  derived and/or modified sequence opt3 from hemagglutinin__InfluenzaA__ADM31728
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucaggaaacggcacuugcuauccaggugacuuuauugauuacgaagaacucagggagcagcugagcaguguuuccucuuucgaacgguuugagaucuucccgaagacaagcuccuggcccaaucacgacucaaacaagggggugaccgccgcuuguccucaugcaggagccaaaaguuuuuauaagaaucugauauggcucgucaaaaagggcaacagcuacccaaaauuaucuaaguccuauaucaaugauaagggcaaagaagugcugguacuuugggggauucaccaccccucaacgagcgcugaccaacagaguuuguaccagaacgccgaugcguacguuuucgugggaacuucucgcuauuccaagaaauuuaagccugagaucgcaauucgaccaaaaguccgugaccaggaggguagaaugaauuacuauuggacccugguggaacccggcgauaagaucacauucgaggccacugggaaccuaguggucccuagguacgcuuuugccauggaacggaacgcaggaagcggcauaauuaccucggacacaccaguucaugauugcaauaccacgugucaaacuccgaaaggugcuaucaacacaucucuccccuuccagaauauucacccuaucaccaucgggaagugcccaaaguaugugaaauccacuaagcugcgccuugccacaggacugagaaacguacccucaauucagaguaggggcuuguuuggcgcgauagccggguucaucgagggagguuggaccggcaugguggacgggugguacggauaucaucaccagaaugaacaaggcagcgguuacgcagcugaccucaaauccacgcagaacgccauugaugagaucaccaauaaggucaacucugugauagagaaaaugaauacacaguuuacugcuguugggaaggaguucaaccaccuggagaagcggauugaaaauuuaaacaaaaagguggacgauggcuuccuggacaucuggaccuacaaugccgagcuccuuguccuguuggaaaacgagcgcacacuagauuaucaugacagcaaugugaaaaaccuguacgagaagguacgaucacagcucaaaaacaaugcaaaggaaaucggaaacggcuguuuugaguucuaucacaagugcgauaauacuuguauggaaaguguuaaaaacgggaccuacgacuauccuaaguacuccgaggaagccaaacugaauagagaggagauugauggagugaaacuugaaagcacaaggaucuaucaaauucuggcuauauacucuaccgucgcgucaaguuuggugcucgucgugagccugggugcaaucuccuuuuggaugugcucuaacggcucguuacagugccggauuuguaucuga

SEQ ID NO: 127718 - RNA, 1701 nt, Artificial Sequence
  derived and/or modified sequence opt3 from hemagglutinin__InfluenzaA__ADM31738
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggcccgcaguuuuuauaaaaaucugauauggcuggugaagaaaggaaacagcuacccaaagcucucuaaauccuauaucaaugacaagggcaaggaaguauuaguucuguggggcauucaccaccccucaacgagcgcugaucaacagagucuuuaccagaacgccgacgcguacguguucgucgggacuucucgauauuccaaaaaguuuaaaccugagaucgcaauucguccaaaggugagagaucaggagggaaggaugaauuacuauuggaccuugguggaacccggugacaaaaucacauucgaggccacuggcaaccuggucguuccucgguacgcuuuugccauggaacgcaacgcagggagcggaauaauuaucucggauaccccagugcaugacugcaauacaaccugucaaacgccgaagggcgcuauuaacacuucucuacccuuccagaauauccacccuaucacaauugguaaaugcccaaaguauguaaaguccaccaaacucagacuggccacugggcuuaggaacgugcccucaauacagagucggggacuguuuggcgcgaucgccggcuucauugaagggggauggacagguauggucgacggcugguacggguaucaucaccagaaugaacaaggaagcggcuacgcagcugauuugaaguccacccagaacgccaucgacgagauaacgaauaaagugaacucuguuauugagaagaugaauacccaguuuacagcuguggguaaagaguucaaccaccucgagaagcgcaucgaaaaucugaacaagaaagucgaugacggguucuuagauaucuggacuuacaaugccgagcugcucgugcuucuggaaaacgagcgaaccuuggacuaucaugauagcaauguaaagaaccuauacgagaaaguuagaucacagcugaagaacaaugcaaaagaaauuggcaacggauguuuugaguucuaucacaagugcgacaauacauguauggaaagugugaagaacggcacuuacgauuauccuaaauacuccgaggaagccaagcucaauagggaggagaucgacggggucaaacuggaaagcacccggauuuaucaaauacuugcuaucuacucuacaguggcgucaagucuggucuuggugguuagccucggagcaauuuccuuuuggaugugcucuaacgguucgcugcagugccguaucuguaucuga

SEQ ID NO: 127719 - RNA, 1701 nt, Artificial Sequence; identical to SEQ ID NO: 126334
  derived and/or modified sequence opt3 from hemagglutinin__InfluenzaA__ADM31748

SEQ ID NO: 127720 - RNA, 1701 nt, Artificial Sequence
  derived and/or modified sequence opt3 from hemagglutinin__InfluenzaA__ADM31758
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugaucgaccccggugauaagauaacauucgaagccacuggcaaccuaguggugccuagguacgcuuuugccauggagcggaacgcagggagcggaauuaucauuucggacaccccaguccaugacugcaauacaaccugucaaacgccgaaaggcgcuaucaacacuucucuccccuuccagaauauccacccuauuacaauagguaagugcccaaaguauguuaaauccaccaagcugcgcauggccacugggcuuagaaacgugcccucaauccagaguaggggacuguuuggcgcgauugccggcuucaucgaagggggauggacagguaugguagauggcugguacggguaucaucaccagaaugagcaaggaagcggcuacgcagcugacuugaaauccacccagaacgccauagaugaaauuacgaauaaggugaacucugucaucgagaaaaugaauacccaguuuacagcuguggguaaggaguucaaccaccucgaaaagcggaucgagaaucugaacaaaaagguugacgauggguucuuagacauuuggacuuacaaugccgaacugcucgugcuucuggagaacgaacgcaccuuggauuaucaugacagcaaugucaaaaaccuauacgagaaggugcgaucacagcugaaaaacaaugcaaaggagaucggcaacggauguuuugaguucuaucacaagugcgauaauacauguauggagaguguuaaaaacggcacuuacgacuauccuaaguacuccgaagaggccaaacucaauagagaagagauugaugggguaaagcuggagagcaccaggauauaucaaauccuugcuauuuacucuacaguggcgucaagucuggucuugguggucagccucggagcaaucuccuuuuggaugugcucuaacgguucgcugcagugccggaucuguauuuga

SEQ ID NO: 127721 - RNA, 1701 nt, Artificial Sequence; identical to SEQ ID NO: 125045
  derived and/or modified sequence opt3 from hemagglutinin__InfluenzaA__ADM31768

SEQ ID NO: 127722 - RNA, 1701 nt, Artificial Sequence; identical to SEQ ID NO: 124685
  derived and/or modified sequence opt3 from hemagglutinin__InfluenzaA__ADM31778

SEQ ID NO: 127723 - RNA, 1701 nt, Artificial Sequence; identical to SEQ ID NO: 126852
  derived and/or modified sequence opt3 from hemagglutinin__InfluenzaA__ADM31798

SEQ ID NO: 127724 - RNA, 1701 nt, Artificial Sequence
  derived and/or modified sequence opt3 from hemagglutinin__InfluenzaA__ADM31808
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugcucugguuagugaaaaagggcaacagcuacccaaaacugucuaaguccuauaucaaugauaagggcaaagaaguacuuguuuugugggggauacaccaccccucaacgagcgcugaccaacagagucuguaccagaacgccgaugcguacguguucgucggaacuucucgcuauuccaagaaauuuaagccugagaucgcaauucgaccaaaagugcgugaccaggaggguagaaugaauuacuauuggacccuagugggccccggggauaagaucacauucgaagccacuggaaaccucgucguuccuagguacgcuuuugccauggagcggaacgcaggcagcgguauuaucauaucggacaccccagugcaugauugcaauacaaccugucaaacgccgaaaggggcuauuaacacuucucugcccuuccagaauauccacccuauuacaaucggaaagugcccaaaguauguaaaauccaccaaacuucgccuggccacuggcuugagaaacgugcccucaauccagaguaggggccucuuuggggcgauugccggauucauagaagguggcuggacagggauggucgacggaugguacggcuaucaucaccagaaugagcaagguagcggguacgcagcugaccugaaauccacccagaacgccaucgaugaaauuacgaauaaggugaacucuguuaucgagaaaaugaauacccaguuuacagcugugggcaaggaguucaaccacuuagaaaagcggauagagaaucugaacaaaaaggucgacgauggauuccucgacauuuggacuuacaaugccgaacuucugguguugcuagagaacgaacgcacccuggauuaucaugacagcaauguaaagaaccucuacgagaagguucgaucacagcugaaaaacaaugcaaaggagaucggcaacggguguuuugaguucuaucacaagugcgauaauacauguauggagagugugaaaaacggaacuuacgacuauccuaaguacuccgaagaggccaaacuuaauagagaagagaucgauggugucaagcuggagagcaccaggauuuaucaaaucuuggcuauuuacucuacaguggcgucaagucucguccuggugguuagcuuaggcgcaauauccuuuuggaugugcucuaacgggucgcugcagugccggaucuguauuuga

SEQ ID NO: 127725 - RNA, 1701 nt, Artificial Sequence; identical to SEQ ID NO: 126852
  derived and/or modified sequence opt3 from hemagglutinin__InfluenzaA__ADM31818

SEQ ID NO: 127726 - RNA, 1701 nt, Artificial Sequence
  derived and/or modified sequence opt3 from hemagglutinin__InfluenzaA__ADM31828
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaagagcuacccaaaauuaucuaaguccuauauaaacgacaagggcaaagaaguacugguucuuuggggcauccaccaccccucaacgagcgcugaucaacagaguuuguaccagaaugccgacgcguacguguucgucgggacuucucgauauuccaagaaauuuaagccugagauugcaauccguccaaaagugagagagcaggaaggaaggaugaacuacuauuggacccugguggagcccggugauaagauuacauucgaagccacuggcaaucuagucguuccucgguacgcuuuugccauggagcgcaacgcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugagacuugccacugggcugaggaaugugcccucaauucagagucggggauuguuuggcgcgauagccggcuucaucgaagggggauggacagguauggucgacggcugguacggguaucaucaccagaacgagcaaggaagcggcuacgcagcugaccucaaauccacccagaaugccauugaugagaucacgaacaagguaaauucuguuauagaaaagaugaacacccaguuuacagcuguggguaaggaguucaaucaccuggaaaagcgcauugagaacuuaaauaaaaaggucgacgauggguuccuggacaucuggacuuacaacgccgaacuccuugugcuguuggagaaugagcgaacccuagauuaucaugacagcaacgugaaaaaucuguacgaaaagguuagaucacagcucaaaaacaacgcaaaggagaucggcaauggauguuuugaguucuaucacaagugcgauaacacauguauggagagugugaaaaauggcacuuacgacuauccuaaguacuccgaagaggccaaacugaacagggaggaaauugauggggucaaacuugagagcacccggaucuaucaaauucuggcuauauacucuacaguggcgucaaguuugguccuccuggugagcuuaggagcaaucuccuuuuggaugugcucuaaugguucgcugcagugccguauuuguaucuga

SEQ ID NO: 127727 - RNA, 1701 nt, Artificial Sequence; identical to SEQ ID NO: 127726
  derived and/or modified sequence opt3 from hemagglutinin__InfluenzaA__ADM31838

SEQ ID NO: 127728 - RNA, 1701 nt, Artificial Sequence; identical to SEQ ID NO: 124685
  derived and/or modified sequence opt3 from hemagglutinin__InfluenzaA__ADM31848

SEQ ID NO: 127729 - RNA, 1701 nt, Artificial Sequence
  derived and/or modified sequence opt3 from hemagglutinin__InfluenzaA__ADM31858
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguagucaugcaggggccaagagcuuuuauaaaaaucugaucuggcucgugaaaaagggaaacucuuacccuaaauuaaauaaguccuauauaaacgacaagggcaaagaaguacugguucuuuggggcauccaccacccaucaacgagcgcugaucaacagaguuuguaccagaaugccgacgcguacguguucgucgggacuucucgcuauuccaagaaauuuaagcccgagauugcaauccgaccuaaagugcgugagcaggaaggaagaaugaacuacuauuggacccugguggagccaggugauaagauuacauucgaagccacuggcaaccuagucguucccagguacgcuuuugccauggagcggaaugcagggagcggaaucauaauuucggacaccccugugcaugauugcaacacaaccugucaaacgccaaaaggcgcuaucaauacuucucucccguuccagaacauucaccccaucacaaucgguaagugcccuaaguauguaaaauccaccaagcugcgccuugccacugggcugagaaaugugccaucaauucagaguaggggauuguuuggcgcgauagccggcuucaucgaagggggauggacagguauggucgacggcugguacggguaucaucaccagaacgagcaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugagaacuuaaauaaaaaggucgacgauggguuccuggacaucuggacuuacaacgccgaacuccuugugcuguuggagaaugagcgcacccuagauuaucaugacagcaacgugaaaaaccuguacgaaaagguucgaucacagcucaaaaauaacgcaaaggagaucggcaauggauguuuugaguucuaucacaagugcgauaacacauguauggaaagugugaaaaauggcacuuacgacuaucccaaguacuccgaagaggccaaacugaacagagaggaaauugauggggucgagcuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 127730 - RNA, 1701 nt, Artificial Sequence
  derived and/or modified sequence opt3 from hemagglutinin__InfluenzaA__ADM31868
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucaauuacgaggagcugagggagcagcugucaagcgugaguuccuucgaacgguuugagauuuucccgaagacaucuagcuggcccaaccacgacuccaauaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcgugcaccaccccuccacgucagcugaccaacagagccuguaccagaaugccgaugcguacgucuucguggggaccagucgcuauucuaagaaauuuaagccugagaucgcaauucgaccaaaagugcgugaccaggagggaagaaugaacuacuauuggacucuagucgaacccggugauaagaucacauucgaggccacuggcaaccucguugugccuagguacgcuuuuuccauggaacggaaugccgggagcggaauuaucauaucggacaccccaguacaugauugcaacacaaccugucaaacgccgaaaggcgcaauuaauacuucucugcccuuccagaacauccacccuauuacaaucgguaagugcccaaaguaugugaaauccaccaaacuucgccuggcuacuggguugagaaauguccccucaauccagaguaggggacucuuuggcgccauugcgggcuucauagaagggggauggacagguaugguggacggcugguacggguaucaucaccagaacgaacaaggaagcggcuacgccgcagaccugaaauccacccagaaugcuaucgauaagauuacgaacaaaguuaauucugugaucgagaagaugaacacccaguuuacagccgucgguaaggaguucaaucacuuagaaaaacggauagagaaccugaauaagaaaguggacgauggguuccucgacauuuggacuuacaacgcugaacuucugguauugcuagagaaugaacgcacccuggauuaucaugacagcaacguuaagaaccucuacgagaaagugcgaucacagcugaagaauaacgccaaggagaucggcaauggauguuuugaguucuaucacaaaugcgauaacacauguauggaaagugucaagaauggcacuuacgacuauccuaaauacuccgaagaggcaaaacuuaacagagaaaagaucgauggggugaagcuggagagcaccaggauuuaucaaaucuuggccauuuacucuacagucgcuucaagucucgugcugguugugagcuuaggagcgauauccuuuuggaugugcucuaaugguucgcugcagugccggaucuguauuuga

SEQ ID NO: 127731 - RNA, 1701 nt, Artificial Sequence
  derived and/or modified sequence opt3 from hemagglutinin__InfluenzaA__ADM31878
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaaggccagcuccuggcccaaucacgauucaaacaagggugucacagcugcauguccucaugccggggcuaaaaguuuuuauaagaaucugauauggcuggugaaaaagggaaacagcuacccaaaacucucuaaguccuauaucaaugacaagggcaaagaaguauuaguucuguggggcauucaccaccccucaaccagcgccgaucaacagagucuuuaccagaacgcggacgcauacguguucgucgggacgucucgcuauuccaagaaauuuaagccugagaucgccauucgaccaaaagugcgugaucaggagggaagaaugaauuacuauuggacuuugguggaacccggugacaagaucaccuucgaggcuacaggcaaccuggucguuccuagguacgccuuugcaauggaacggaacgcugggagcggaauaauuaucucggauacuccagugcaugacugcaauaccacaugucaaaccccgaaaggcgccauuaacacgucucuacccuuccagaauauccacccuaucacuauugguaagugcccaaaguauguaaaauccacaaagcuccgccuggcgaccgggcuuagaaacgugcccucaauacagaguaggggacuguuuggcgccaucgcaggcuucauugaagggggauggacugguauggucgacggcugguacggguaucaucaccagaaugaacaaggaagcggcuacgcugccgauuugaaauccacacagaacgcuaucgacgagauaaccaauaaggugaacucuguuauugagaaaaugaauacgcaguuuaccgccguggguaaggaguucaaccaccucgagaagcggaucgaaaaucugaacaaaaaggucgaugacggguucuuagauaucuggacauacaaugcagagcugcucgugcuucuggaaaacgagcgcacuuuggacuaucaugauagcaauguuaaaaaccuauacgagaagguacgaucacagcugaaaaacaaugccaaggaaauuggcaacggauguuuugaguucuaucacaagugcgacaauaccuguauggaaagugugaaaaacggcacauacgauuauccuaaguacuccgaggaagcuaaacucaauagagaggagaucgacggggucaagcuggaaagcacuaggauuuaucaaauacuugcgaucuacucuaccguggcaucaagucuggucuuggugguuagccucggagccauuuccuuuuggaugugcucuaacgguucgcugcagugccggaucuguaucuga

SEQ ID NO: 127732 - RNA, 1701 nt, Artificial Sequence; identical to SEQ ID NO: 126334
  derived and/or modified sequence opt3 from hemagglutinin__InfluenzaA__ADM31888

SEQ ID NO: 127733 - RNA, 1701 nt, Artificial Sequence; identical to SEQ ID NO: 124865
  derived and/or modified sequence opt3 from hemagglutinin__InfluenzaA__ADM31898

SEQ ID NO: 127734 - RNA, 1701 nt, Artificial Sequence
  derived and/or modified sequence opt3 from hemagglutinin__InfluenzaA__ADM31908
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugaccacgaagaguugagggagcagcucagcaguguguccucuuucgaacgguuugagaucuucccgaagacaagcuccuggcccaaucaugauucaaacaagggugucaccgccgcuuguccucacgcaggggccaaaaguuuuuacaagaaucugauauggcuggugaaaaagggaaacagcuauccaaaacucucuaaguccuacaucaaugacaagggcaaagaaguauuaguucuguggggcauucaccaucccucaacgagcgcugaucaacagagucuuuaucagaacgccgacgcguacguguucgucgggucuucccgcuacagcaagaaauuuaagccugagaucgcaauucgaccaaaagugcgugaucaggagggaagaaugaauuauuacuggacuuugguggaacccggugacaagaucaccuucgaggccacaggcaaccuggucguuccuagguaugcuuuugccauggaacggaacgcagggucgggaauaauuaucucugauacuccagugcacgacugcaauaccacaugucaaaccccgaaaggcgcuauuaacacgucccuacccuuccagaauauccauccuaucacuauugguaagugcccaaaguacguaaaaucaacaaagcuccgccuggccaccgggcuuagaaacgugcccaguauacagagcaggggacuguuuggcgcgaucgccggcuucauugaagggggauggacugguauggucgacggcugguauggguaccaccaccagaaugaacaaggauccggcuaugcagcugauuugaaaucuacacagaacgccaucgacgagauaaccaauaaggugaacagcguuauugagaaaaugaauacgcaguuuaccgcuguggguaaggaguucaaccaucucgagaagcggaucgaaaaucugaacaaaaaggucgaugacggguucuuagauaucuggacauacaaugccgagcugcucgugcuucuggaaaacgagcgcacuuuggacuaccacgauucaaauguuaaaaaccuauaugagaagguacgaagucagcugaaaaacaaugcaaaggaaauuggcaacggauguuuugaguucuaccauaagugcgacaauaccuguauggaauccgugaaaaacggcacauaugauuacccuaaguauagcgaggaagccaaacucaauagagaggagaucgacggggucaagcuggaaucuacuaggauuuaccaaauacuugcuaucuauucaaccguggcgaguagccuggucuuggugguuucccucggagcaauuucuuuuuggaugugcucgaacgguagccugcagugccggaucuguaucuga

SEQ ID NO: 127735 - RNA, 1701 nt, Artificial Sequence; identical to SEQ ID NO: 124865
  derived and/or modified sequence opt3 from hemagglutinin__InfluenzaA__ADM31918

SEQ ID NO: 127736 - RNA, 1701 nt, Artificial Sequence; identical to SEQ ID NO: 126457
  derived and/or modified sequence opt3 from hemagglutinin__InfluenzaA__ADM31928

SEQ ID NO: 127737 - RNA, 1701 nt, Artificial Sequence; identical to SEQ ID NO: 126457
  derived and/or modified sequence opt3 from hemagglutinin__InfluenzaA__ADM31948

SEQ ID NO: 127738 - RNA, 1701 nt, Artificial Sequence; identical to SEQ ID NO: 124685
  derived and/or modified sequence opt3 from hemagglutinin__InfluenzaA__ADM31958

SEQ ID NO: 127739 - RNA, 1701 nt, Artificial Sequence; identical to SEQ ID NO: 126457
  derived and/or modified sequence opt3 from hemagglutinin__InfluenzaA__ADM31968

SEQ ID NO: 127740 - RNA, 1701 nt, Artificial Sequence; identical to SEQ ID NO: 126273
  derived and/or modified sequence opt3 from hemagglutinin__InfluenzaA__ADM31978

SEQ ID NO: 127741 - RNA, 1701 nt, Artificial Sequence; identical to SEQ ID NO: 124865
  derived and/or modified sequence opt3 from hemagglutinin__InfluenzaA__ADM31998

SEQ ID NO: 127742 - RNA, 1701 nt, Artificial Sequence; identical to SEQ ID NO: 124865
  derived and/or modified sequence opt3 from hemagglutinin__InfluenzaA__ADM32008

SEQ ID NO: 127743 - RNA, 1701 nt, Artificial Sequence
  derived and/or modified sequence opt3 from hemagglutinin__InfluenzaA__ADM32018
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcgacaucgccggcuggauucuggggaacccugagugugaaucuuugucaaccgcaaguagcugguccuacaucguugagacaucuucgucagauaauggaaccugcuauccaggcgacuuuauugauuacgaggagcucagggagcagcugagcaguguguccucuuucgaacgguuugagaucuucccgaagacuagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccagcgcugaccaacagaguuuguaccagaaugccgaugcguacguguucgucgggacgucucgcuauuccaagaaauuuaagccugagaucgcaauucgaccaaaagugcgugaccaggagggaagaaugaacuacuauuggacucugguggaacccggugauaagaucaccuucgaggccacaggcaaucuagucguuccuagguacgcuuuugccauggaacggaacgcagggagcggaauaauuaucucggacacuccagugcaugacugcaacaccacaugucaaaccccgaaaggcgcuauuaauacgucucuccccuuccagaacauccacccuaucacuauugguaagugcccaaaguauguaaaauccacaaagcugcgccuugccaccgggcugagaaaugugcccucaauacagaguaggggauuguuuggcgcgaucgccggcuucauugaagggggauggacugguauggucgauggcugguacggguaucaucaccagaacgaacaaggaagcggcuacgcagcugaccucaaauccacacagaaugccaucgaugagauaaccaacaagguaaauucuguuauugagaaaaugaacacgcaguuuaccgcuguggguaaggaguucaaucaccuggaaaagcggaucgaaaacuuaaauaaaaaggucgacgauggguuccuggacaucuggacauacaacgccgagcuccuugugcuguuggaaaaugagcgcacucuagauuaucaugacagcaacgugaaaaaucuguacgagaagguucgaucacagcucaaaaacaacgcaaaggaaauuggcaauggauguuuugaguucuaucacaagugcgauaacaccuguauggaaagugugaaaaauggcacauacgacuauccuaaguacuccgaggaagccaaacugaacagagaggagaucgauggggucaaacuugaaagcacuaggauuuaucaaauacuggcuaucuacucuaccguggcgucaaguuugguccucgugguuagccugggagcaauuuccuuuuggaugugcucuaaugguucguuacagugccggaucuguaucuga

SEQ ID NO: 127744 - RNA, 1701 nt, Artificial Sequence
  derived and/or modified sequence opt3 from hemagglutinin__InfluenzaA__ADM32028
augaaggccauccuggugguccuccuuuacaccuucgcuacagcaaacgccgacacucugugcauuggcuaucacgcgaauaacagcacggauaccguugacacaguguuggagaagaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacguacacccuauuacaaucgguaagugcccaaaguaugugaaauccaccaagcugcgccuugccacugggcugagaaauguccccucaauccagaguaggggauuguuuggcgcgauugccggcuucauagaagggggauggacagguaugguggauggcugguacggguaucaucaccagaacgaacaaggaagcggcuacgcagcugaccucaaauccacccagaaugccaucgaugagauuacgaacaagguuaauucugugaucgagaaaaugaacacccaguuuacagcugucgguaaggaguucaaucaccuggaaaagcggauagaaaacuuaaauaaaaagguggacgauggguuccuggacauuuggacuuacaacgccgagcuccuuguacuguuggaaaaugagcgcacccuagauuaucaugacagcaacguuaaaaaucuguacgagaaggugcgaucacagcucaaaaacaacgcaaaggaaaucggcaauggauguuuugaguucuaucacaagugcgauaacacauguauggaaagugucaaaaauggcacuuacgacuauccuaaguacuccgaggaagccaaacugaacagagaggagaucgauggggugaaacuugaaagcaccaggauuuaucaaauccuggcuauuuacucuacagucgcgucaaguuuggugcucguugugagccugggagcaauauccuuuuggaugugcucuaaugguucguuacagugccggaucuguauuuga

SEQ ID NO: 127745 - RNA, 1701 nt, Artificial Sequence; identical to SEQ ID NO: 126457
  derived and/or modified sequence opt3 from hemagglutinin__InfluenzaA__ADM32038

SEQ ID NO: 127746 - RNA, 1701 nt, Artificial Sequence; identical to SEQ ID NO: 124865
  derived and/or modified sequence opt3 from hemagglutinin__InfluenzaA__ADM32048

SEQ ID NO: 127747 - RNA, 1701 nt, Artificial Sequence; identical to SEQ ID NO: 125849
  derived and/or modified sequence opt3 from hemagglutinin__InfluenzaA__ADM32058

SEQ ID NO: 127748 - RNA, 1701 nt, Artificial Sequence; identical to SEQ ID NO: 125849
  derived and/or modified sequence opt3 from hemagglutinin__InfluenzaA__ADM32068

SEQ ID NO: 127749 - RNA, 1701 nt, Artificial Sequence; identical to SEQ ID NO: 124685
  derived and/or modified sequence opt3 from hemagglutinin__InfluenzaA__ADM32078

SEQ ID NO: 127750 - RNA, 1701 nt, Artificial Sequence; identical to SEQ ID NO: 126273
  derived and/or modified sequence opt3 from hemagglutinin__InfluenzaA__ADM32088

SEQ ID NO: 127751 - RNA, 1701 nt, Artificial Sequence
  derived and/or modified sequence opt3 from hemagglutinin__InfluenzaA__ADM32098
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 127752 - RNA, 1701 nt, Artificial Sequence; identical to SEQ ID NO: 124685
  derived and/or modified sequence opt3 from hemagglutinin__InfluenzaA__ADM32108

SEQ ID NO: 127753 - RNA, 1701 nt, Artificial Sequence; identical to SEQ ID NO: 126457
  derived and/or modified sequence opt3 from hemagglutinin__InfluenzaA__ADM32551

SEQ ID NO: 127754 - RNA, 1701 nt, Artificial Sequence; identical to SEQ ID NO: 124865
  derived and/or modified sequence opt3 from hemagglutinin__InfluenzaA__ADM32561

SEQ ID NO: 127755 - RNA, 1701 nt, Artificial Sequence; identical to SEQ ID NO: 124865
  derived and/or modified sequence opt3 from hemagglutinin__InfluenzaA__ADM32571

SEQ ID NO: 127756 - RNA, 1701 nt, Artificial Sequence; identical to SEQ ID NO: 124685
  derived and/or modified sequence opt3 from hemagglutinin__InfluenzaA__ADM32581

SEQ ID NO: 127757 - RNA, 1701 nt, Artificial Sequence; identical to SEQ ID NO: 126457
  derived and/or modified sequence opt3 from hemagglutinin__InfluenzaA__ADM32591

SEQ ID NO: 127758 - RNA, 1701 nt, Artificial Sequence; identical to SEQ ID NO: 124685
  derived and/or modified sequence opt3 from hemagglutinin__InfluenzaA__ADM32601

SEQ ID NO: 127759 - RNA, 1701 nt, Artificial Sequence; identical to SEQ ID NO: 124685
  derived and/or modified sequence opt3 from hemagglutinin__InfluenzaA__ADM32611

SEQ ID NO: 127760 - RNA, 1701 nt, Artificial Sequence; identical to SEQ ID NO: 125849
  derived and/or modified sequence opt3 from hemagglutinin__InfluenzaA__ADM32621

SEQ ID NO: 127761 - RNA, 1701 nt, Artificial Sequence
  derived and/or modified sequence opt3 from hemagglutinin__InfluenzaA__ADM32631
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacauauuagaagauaagcacaaugggaaacuguguaagcuaaaaggaguggcuccccuccaucuggguaagugcaacaucgccggcuggauucuugggaauccugagugugaaucucugucaacagcaaguagcugguccuacaucguugagaccucuucgucagacaacggaacuugcuauccaggcgauuuuauugacuacgaagaguugagagagcagcucagcaguguguccucuuucgaaagguuugagaucuucccgaagacaagcuccuggcccaaucacgauucaaacaaaggugucaccgccgcuuguccucaugcaggggccaagaguuuuuauaaaaaucugauauggcuggugaagaaaggaaaccucuacccaaaguuaagcaagucuuauaucaaugacaaaggcaaggaaguacugguucuuuggggcauucaccaccccuccacgucagcugaucaacagagcuuguaccagaacgccgacgcguacguguucgucgggaguucuaaauauuccaagaaauuuaagccugagaucgcaauucggccaaaagugcgcgaucaggagggacgaaugaauuacuauuggacucugguggaacccggugacaagaucaccuucgaggccacaggcaaccuagucguuccucguuacgcuuuugccauggaaagaaacgcagggagcggaauaauuaucucggauacuccagugcauaauugcaacaccacaugucaaaccccgaagggcgcuauuaauacgucucuccccuuccagaacauccacccuaucacuauugguaaaugcccaaaguauguaaaauccacaaagcugaggcuugccaccgggcugcggaaugugcccucaauacagagucgcggauuguuuggcgcgaucgccggcuucauugaagggggauggacugguauggucgacggcugguacggguaucaucaccagaacgaacaaggaagcggcuacgcagcugaccucaaauccacacagaaugccaucgaugagauaaccaacaagguaaauucuguuauugagaagaugaacacgcaguuuaccgcuguggguaaagaguucaaucaccuggagaagagaaucgaaaacuuaaauaaaaaggucgacgauggguuccuggacaucuggacauacaacgccgagcuccuugugcuguuggaaaaugagaggacucuagauuaucaugacagcaacgugaaaaaccuguacgagaagguucggucacagcucaagaauaacgcaaaagaaauuggcaauggauguuuugaguucuaucacaagugcgauaacaccuguauggaaagugugaaaaauggcacauacgacuauccuaaguacuccgaggaagccaaacugaaccgcgaggagaucgauggggucaaacuugaaagcacucgaauuuaucaaauacuggcuaucuacucuaccguggcgucaaguuugguccucgugguuagccugggagcaauuuccuuuuggaugugcucuaaugguucguuacagugcagaaucuguaucuga

SEQ ID NO: 127762 - RNA, 1701 nt, Artificial Sequence; identical to SEQ ID NO: 125849
  derived and/or modified sequence opt3 from hemagglutinin__InfluenzaA__ADM32641

SEQ ID NO: 127763 - RNA, 1701 nt, Artificial Sequence; identical to SEQ ID NO: 124685
  derived and/or modified sequence opt3 from hemagglutinin__InfluenzaA__ADM32651

SEQ ID NO: 127764 - RNA, 1701 nt, Artificial Sequence
  derived and/or modified sequence opt3 from hemagglutinin__InfluenzaA__ADM32661
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuaaugacuacgaggagcucagggagcagcugagcaguguguccucuuucgaacgguuugagauuuucccgaagacuagcuccuggcccaaccacgauucaaauaagggugucacagccgcuuguccucaugcaggggccaaaaguuuuuauaagaaccugaucuggcucgugaaaaagggaaauagcuacccaaaauuaucuaaguccuauauaaacgacaagggcaaagaaguacugguucuuuggggcauccaccaccccucaaccagcgcugaucaacagaguuuguaccagaaugccgacgcguacguguucgucgggacgucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 127765 - RNA, 1701 nt, Artificial Sequence; identical to SEQ ID NO: 126273
  derived and/or modified sequence opt3 from hemagglutinin__InfluenzaA__ADM32671

SEQ ID NO: 127766 - RNA, 1701 nt, Artificial Sequence; identical to SEQ ID NO: 124685
  derived and/or modified sequence opt3 from hemagglutinin__InfluenzaA__ADM32681

SEQ ID NO: 127767 - RNA, 1701 nt, Artificial Sequence; identical to SEQ ID NO: 124865
  derived and/or modified sequence opt3 from hemagglutinin__InfluenzaA__ADM32691

SEQ ID NO: 127768 - RNA, 1701 nt, Artificial Sequence; identical to SEQ ID NO: 124685
  derived and/or modified sequence opt3 from hemagglutinin__InfluenzaA__ADM32701

SEQ ID NO: 127769 - RNA, 1701 nt, Artificial Sequence; identical to SEQ ID NO: 124865
  derived and/or modified sequence opt3 from hemagglutinin__InfluenzaA__ADM32711

SEQ ID NO: 127770 - RNA, 1701 nt, Artificial Sequence; identical to SEQ ID NO: 124865
  derived and/or modified sequence opt3 from hemagglutinin__InfluenzaA__ADM32721

SEQ ID NO: 127771 - RNA, 1701 nt, Artificial Sequence; identical to SEQ ID NO: 124865
  derived and/or modified sequence opt3 from hemagglutinin__InfluenzaA__ADM32741

SEQ ID NO: 127772 - RNA, 1701 nt, Artificial Sequence; identical to SEQ ID NO: 124865
  derived and/or modified sequence opt3 from hemagglutinin__InfluenzaA__ADM32751

SEQ ID NO: 127773 - RNA, 1701 nt, Artificial Sequence; identical to SEQ ID NO: 126273
  derived and/or modified sequence opt3 from hemagglutinin__InfluenzaA__ADM32761

SEQ ID NO: 127774 - RNA, 1701 nt, Artificial Sequence
  derived and/or modified sequence opt3 from hemagglutinin__InfluenzaA__ADM32771
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucugaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaagggauuguuuggcgcgauagccggcuucaucgaagggggauggacagguauggucgacggcugguacggguaucaucaccagaaugagcaaggaagcggcuacgcagcugaucucaaauccacccagaacgccauugacgagaucacgaauaaggugaacucuguuauagaaaagaugaauacccaguuuacagcuguggguaaggaguucaaccaccuggaaaagaggauugagaauuuaaacaaaaaggucgaugacggguuccuggauaucuggacuuacaaugccgaacuccuugugcuguuggagaacgagcggacccuagacuaucaugauagcaauguuaaaaaccuguacgaaaagguacgcucacagcucaaaaacaaugcaaaggagaucggcaacggauguuuugaguucuaucacaagugcgacaauacauguauggagagugugaaaaacggcacuuacgauuauccuaaguacuccgaagaggccaaacugaaucgagaggaaauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 127775 - RNA, 1701 nt, Artificial Sequence
  derived and/or modified sequence opt3 from hemagglutinin__InfluenzaA__ADM32781
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucuuuccccuuucagaacauucacccuaucacaaucgguaagugcccaaaguauguaaaauccaccaagcuccgccuggccacugggcuuagaaaugugcccucaauucagaguaggggacuguucggcgcgauagccggcuuuaucgaagggggauggacagguauggucgauggcugguacggguaucaucaccagaacgaacaaggaagcggcuacgcagcugacuugaaauccacccagaaugccauugaugagaucacgaacaagguaaauucuguuauagagaaaaugaacacccaguucacagcuguggguaaggaguucaaucaccucgaaaagcggauugaaaaccugaauaaaaaggucgacgauggguuuuuagacaucuggacuuacaacgccgagcugcucgugcuucuggaaaaugagcgcaccuuggauuaucaugacagcaacgugaaaaaucuauacgagaagguucgaucacagcugaaaaacaacgcaaaggaaaucggcaauggauguuucgaguuuuaucacaagugcgauaacacauguauggaaagugugaaaaauggcacuuacgacuauccuaaguacuccgaggaagccaaacucaacagagaggagauugauggggucaagcuggaaagcaccaggaucuaucaaauucuugcuauauacucuacaguggcgucaagucuggucuuggugguuagccucggagcaaucuccuucuggaugugcucuaaugguucgcugcagugccggauuuguaucuga

SEQ ID NO: 127776 - RNA, 1701 nt, Artificial Sequence; identical to SEQ ID NO: 124865
  derived and/or modified sequence opt3 from hemagglutinin__InfluenzaA__ADM32791

SEQ ID NO: 127777 - RNA, 1701 nt, Artificial Sequence
  derived and/or modified sequence opt3 from hemagglutinin__InfluenzaA__ADM32801
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaaaauaagcacaacgggaaacuguguaagcuaagaggaguggcuccccuccaucuggguaaaugcaauaucgccggcuggauucuugggaacccugagugugaaucucugucaacagcaaguagcugguccuacaucguugagaccucuucgucagauaauggaacuugcuauccaggcgacuuuauugauuacgaagaguugagggagcagcucagcaguguguccucuuucgaacgguuugagaucuucccgaagacaagcuccuggcccaaccacgacucaaauaagggugucaccgccgcuuguccucaugcaggggccaaaaguuuuuauaagaaccugauauggcuggugaaaaagggaaauagcuacccaaaacucucuaaguccuauaucaacgauaagggcaaagaaguauuaguucuguggggcauucaccaccccucaacgagcgcugaccaacagagucuuuaccagaaugccgaugcguacguguucgucgggucuucccgcuauagcaagaaauuuaagccugagaucgcaauucgaccaaaagugcgugaccaggagggaagaaugaacuacuauuggacuuugguggaacccggugauaagaucaccuucgaggccacaggcaaccuggucguuccuagguacgcuuuugccauggaacggaaugcagggucgggaauaauuaucucugacacuccagugcaugauugcaacaccacaugucaaaccccgaaaggcgcuauuaauacgucccuacccuuccagaacauccacccuaucacuauugguaagugcccaaaguauguaaaaucaacaaagcuccgccuggccaccgggcuuagaaaugugcccaguauacagagcaggggacuguuuggcgcgaucgccggcuucauugaagggggauggacugguauggucgacggcugguacggguaucaucaccagaacgaacaaggauccggcuacgcagcugacuugaaaucuacacagaaugccaucgaugagauaaccaacaaggugaauagcguuauugagaaaaugaacacgcaguuuaccgcuguggguaaggaguucaaucaccucgagaagcggaucgaaaaccugaauaaaaaggucgacgauggguucuuagacaucuggacauacaacgccgagcugcucgugcuucuggaaaaugagcgcacuuuggauuaucaugacucaaacguuaaaaaccuauacgagaagguacgaagucagcugaaaaauaacgcaaaggaaauuggcaauggauguuuugaguucuaucacaagugcgauaacaccuguauggaauccgugaaaaauggcacauacgacuauccuaaguacagcgaggaagccaaacucaacagagaggagaucgauggggucaagcuggaaucuacuaggauuuaucaaauacuugcuaucuacucaaccguggcgaguagccuggucuuggugguuucccucggagcaauuucuuuuuggaugugcucgaaugguagccugcagugccggaucuguaucuga

SEQ ID NO: 127778 - RNA, 1701 nt, Artificial Sequence
  derived and/or modified sequence opt3 from hemagglutinin__InfluenzaA__ADM32811
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccacaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaccagaaugaacagggaagcggcuacgcagcugaucucaaauccacccaaaacgccauugacgagaucacgaauaaggugaacucuguuauagagaaaaugaauacccaguuuacagcuguggguaaggaguucaaccaucuggaaaagcggauugaaaauuuaaacaaaaaggucgaugacggguuccuggauaucuggacuuacaaugccgagcuccuugugcuguuggaaaacgagcgcacccuagacuaucacgauagcaauguaaagaaccuguacgagaagguucgaucacagcucaaaaacaaugcaaaggaaaucggcaacggauguuuugaguucuaucauaagugcgacaauacauguauggaaagugugaaaaacggcacuuacgauuauccuaaguacuccgaggaagccaaacugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacaaugccggauuuguaucuga

SEQ ID NO: 127779 - RNA, 1701 nt, Artificial Sequence; identical to SEQ ID NO: 124685
  derived and/or modified sequence opt3 from hemagglutinin__InfluenzaA__ADM32821

SEQ ID NO: 127780 - RNA, 1701 nt, Artificial Sequence; identical to SEQ ID NO: 126273
  derived and/or modified sequence opt3 from hemagglutinin__InfluenzaA__ADM32831

SEQ ID NO: 127781 - RNA, 1701 nt, Artificial Sequence; identical to SEQ ID NO: 124865
  derived and/or modified sequence opt3 from hemagglutinin__InfluenzaA__ADM32841

SEQ ID NO: 127782 - RNA, 1701 nt, Artificial Sequence; identical to SEQ ID NO: 126273
  derived and/or modified sequence opt3 from hemagglutinin__InfluenzaA__ADM32851

SEQ ID NO: 127783 - RNA, 1701 nt, Artificial Sequence; identical to SEQ ID NO: 124865
  derived and/or modified sequence opt3 from hemagglutinin__InfluenzaA__ADM32861

SEQ ID NO: 127784 - RNA, 1701 nt, Artificial Sequence; identical to SEQ ID NO: 125849
  derived and/or modified sequence opt3 from hemagglutinin__InfluenzaA__ADM32871

SEQ ID NO: 127785 - RNA, 1701 nt, Artificial Sequence; identical to SEQ ID NO: 126852
  derived and/or modified sequence opt3 from hemagglutinin__InfluenzaA__ADM32881

SEQ ID NO: 127786 - RNA, 1701 nt, Artificial Sequence
  derived and/or modified sequence opt3 from hemagglutinin__InfluenzaA__ADM32929
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacggugccguauuuguaucuga

SEQ ID NO: 127787 - RNA, 1701 nt, Artificial Sequence
  derived and/or modified sequence opt3 from hemagglutinin__InfluenzaA__ADM32939
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacauucccaguauacagagcaggggauuguuuggcgcgaucgccggcuucauugaagggggauggacugguaugguggacggcugguacggguaucaccaccagaaugagcagggauccggcuacgcagcugaucucaagucuacacaaaacgccaucgacgagauaaccaauaaagucaacagcgugauugaaaagaugaauacgcaguuuaccgcuguugguaaagaguucaaccaucuggaaaagcggaucgagaauuuaaacaagaaaguggaugacggguuccuggauaucuggacauacaaugccgaacuccuuguccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacggugccguaucuguaucuga

SEQ ID NO: 127788 - RNA, 1701 nt, Artificial Sequence
  derived and/or modified sequence opt3 from hemagglutinin__InfluenzaA__ADM32949
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaacggcgcuaucaauacuucucuccccuuccagaacauucacccuaucacaaucgguaaaugcccaaaguauguaaaguccaccaaacugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaucucaaguccacccagaaugccaucgacgagauaacgaacaaagucaauucugugauugagaagaugaacacccaguuuacagcuguugguaaagaguucaaucaccuggaaaagcggaucgaaaacuuaaauaagaaaguggaugacggguuccuggauaucuggacuuacaacgccgagcuccuuguccuguuggaaaaugagcgcacccuagacuaucaugauagcaacgugaagaaccuguacgagaaaguacgaucacagcucaagaauaacgcaaaagaaauuggcaauggauguuuugaguucuaucacaagugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacggugccguaucuguaucuga

SEQ ID NO: 127789 - RNA, 1701 nt, Artificial Sequence
  derived and/or modified sequence opt3 from hemagglutinin__InfluenzaA__ADM32958
augaaggccauccugguguuccuccuuuacaccuuugcuacagcaaacgccgacacucugugcauuggauaucacgcgaauaacagcacggauaccgucgacacaguuuuggagaaaaaugugacuguaacccauuccgugaacauauuagaagauaagcacaaugggaaacuguguaagcuaagaggagucgcuccccuccaucuggguaaaugcaacaucgccggcuggauucuugggaauccugagugugaaucucugucaacagcaaguagcugguccuacaucguggagaccucuucgucagacaacggaacuugcuauccaggcgauuucauugacuacgaagaguugagggagcagcucagcaguguuuccucuuuugaacgguucgagaucuuuccgaagacaagcuccuggcccaaucacgauucaaacaagggugugaccgccgcuuguccucaugcaggggccaaaaguuucuauaagaaucugauauggcuggucaaaaagggaaacagcuacccaaaacucucuaaguccuauaucaaugacaagggcaaagaaguguuaguacuguggggcauucaccaccccucaacgagcgcugaucaacagagucuuuaccagaacgccgacgcguacguuuuuguggagucuucccgcuauagcaagaaauucaagccugagaucgcaauucgaccaaaaguccgugaucaggaagggagaaugaauuacuauuggacuuugguggagcccggagacaagaucaccuuugaagccacagguaaccugguggucccuagguacgcuuucgccauggagcggaacgcaggcucggggauaauuaucucugauacuccaguucaugacugcaauaccacaugucaaaccccgaaaggagcuauuaacacgucccuacccuuucagaauauccacccuaucacuauuggcaagugcccaaaguaugugaaaucaacaaagcuccgccuggccaccggucuuagaaacguacccaguauacagagcagggggcuguucggagcgaucgccggcuuuauugaaggcggguggacuggaaugguggacgguugguacggcuaucaucaccagaaugagcaaggguccggauacgcagcugauuugaaaucuacacagaacgccaucgacgagauaaccaauaaggucaacagcgugauugaaaagaugaauacgcaguucaccgcuguuggcaaggaguucaaccaccucgaaaagcggcuggagaauuuaaacaaaaagguggaugacgguuuucuggauaucuggacauacaaugccgaacuccuuguccuguuggagaacgagcgcacucuagacuaucaugauucaaaugugaaaaaccuguacgaaaagguacgaagucagcucaaaaacaaugcaaaggagguugggaacggcuguuucgaauuuuaucacaagugcgacaauaccuguauggaguccgugaaaaacggaacauacgauuauccuaaguacagcgaagaggccaaacugaauagagaggaaaucgacggcgucaaacuugagucuacuaggauuuaucaaauccuggcuauuuacucaaccgcggcaaguagcuuggugcucgucgugucccugggggccauaucuuucuggaugugcucgaacggcagcuuacggugccguaucuguauuuga

SEQ ID NO: 127790 - RNA, 1701 nt, Artificial Sequence
  derived and/or modified sequence opt3 from hemagglutinin__InfluenzaA__ADM32977
augaaggccauccuggugguccuccuuugcaccuucgcuacagcaaacgccgacacucuguguauuggcuaccacgcgaauaacagcacggauaccguugacacaguguuggagaaaaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaagaacucagggagcagcugagcaguguguccucuuucgaacgguuugagauuuucccgaagacaagcuccuggcccaaucacgauucaaacaagggugucaccgccgcuugcccucaugcaggggccaaaaguuuuuacaagaaucugaucuggcucgugaaaaagggaaacagcuauccaaaauuaucuaaguccuacauaaaugacaagggcaaagaaguacugguucuuuggggcauccaccaccccucaacgagcgcugaucaacagaguuuguaucagaacgccgacgcguacguguucgucgggacuucuaaguacuccaaaaaguuuaaaccugagauugcaauccgcccaaaggugcgagaucaggagggacguaugaauuauuacuggacccugguggaacccggugacaaaauuacauucgaggccacuggcaaccuagucguuccuagauaugcuuuugccauggaaaggaacgcagggagcggaaucauaauuucggauaccccagugcaugacuguaauacaaccugccaaacgccgaagggcgcuaucaacacuucucuccccuuccagaauauucacccuaucacaaucgguaaguguccaaaauacguaaaguccaccaaacugcggcuugccacugggcugcgcaacgugcccucaauucagaguagaggauuguuuggcgcgauagccggcuucaucgaagggggauggacagguauggucgacggcugguauggguaccaucaccagaaugaacaaggaagcggcuaugcagcugaucucaaguccacccagaacgccauugacgguaucacgaauaaaauaaacucugugauugagaagaugaauacccaguuuacagcuguugggaaggaguucaaccaccuggagaaaaggaucgagaauuuaaacaagaaaguggaugacggcuuccuggauaucuggacuuacaaugccgaacuccuuguccuguuggagaacgaacggacccuagacuaccaugauagcaaugugaagaaccuguaugagaaaguacgcucacagcucaagaacaaugcaaaggagauuggaaacggcugcuuugaguucuaccacaaaugugacaauacaugcauggagaguguuaagaacgggacuuaugauuacccuaaauauuccgaagaggccaagcugaaucgagaagagaucgacggagugaaacuugagagcaccagaauuuaccaaauacuggcuaucuauucuacagucgcgucaaguuuggugcucgucgugagccugggugcaauuuccuuuuggaugugcucuaacggcucguuaaggugucggaucugcaucuga

SEQ ID NO: 127791 - RNA, 1701 nt, Artificial Sequence
  derived and/or modified sequence opt3 from hemagglutinin__InfluenzaA__ADM32986
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaaauagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccaguaaguauucuaaaaaguuuaaaccugagauugcaauccgcccaaaggugcgagaucaggagggacguaugaacuacuauuggacucugguggaacccggugacaaaauuacauucgaggccacuggcaaccuagucguuccuagauacgcuuuugccauggaaaggaaugcaggguccggaaucauaauuagcgauaccccagugcaugacugcaacacaaccugucaaacgccgaagggcgcuaucaauacuucgcuccccuuccagaacauucacccuaucacaaucgguaagugcccaaaauauguaaagucuaccaaacugcggcuugccacugggcugcgcaaugugcccuccauucagucaagaggauuguuuggcgcgauagccggcuucaucgaagggggauggacagguauggucgacggcugguacggguaucaucaccagaacgaacaaggaaguggcuacgcagcugaucucaagagcacccagaaugccauugacgguaucacgaacaaaauaaauuccgugauugagaagaugaacacccaguuuacagcuguugggaaggaguucaaucaccuggagaaaaggaucgagaacuuaaauaagaaaguggaugacggcuuccuggauaucuggacuuacaacgccgaacuccuuguccuguuggagaaugaacggacccuaaacuaucaugacucuaacgugaagaaucuguacgagaaaguacgcagccagcucaagaacaaugcaaaggagauuggaaacggcuguuuugaguucuaucacaaaugcgauaauacauguauggagucaguuaagaacgggacuuacgacuauccuaaauacagugaagaggccaagcugaaucgagaagagaucgauggagugaaacuugaguccaccagaauuuaucaaauacuggcuaucuacagcacagucgcgucuucauuggugcucgucgugagucugggugcaauuagcuuuuggaugugcuccaacggcucuuuaaggugccggaucuguaucuga

SEQ ID NO: 127792 - RNA, 1701 nt, Artificial Sequence
  derived and/or modified sequence opt3 from hemagglutinin__InfluenzaA__ADM32995
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaaauagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccaguaaguauucuaaaaaguuuaaaccugagauugcaauccgcccaaaggugcgagaucaggagggacguaugaacuacuauuggacucugguggaacccggugacaaaauuacauucgaggccacuggcaaccuagucguuccuagauacgcuuuugccauggaaaggaaugcaggguccggaaucauaauuagcgauaccccagugcaugacugcaacacaaccugucaaacgccgaagggcgcuaucaauacuucgcuccccuuccagaacauucacccuaucacaaucgguaagugcccaaaauauguaaagucuaccaaacugcggcuugccacugggcugcgcaaugugcccuccauucagucaagaggauuguuuggcgcgauagccggcuucaucgaagggggauggacagguauggucgacggcugguacggguaucaucaccagaacgaacaaggaaguggcuacgcagcugaucucaagagcacccagaaugccauugacgguaucacgaacaaaauaaauuccgugauugagaagaugaacacccaguuuacagcuguugggaaggaguucaaucaccuggagaaaaggaucgagaacuuaaauaagaaaguggaugacggcuuccuggauaucuggacuuacaacgccgaacuccuuguccuguuggagaaugaacggacccuagacuaucaugauucuaacgugaagaaccuguacgagaaaguacgcagccagcucaagaauaacgcaaaggagauuggaaauggcuguuuugaguucuaucacaaaugcgacaacacauguauggagucaguuaagaaugggacuuacgauuauccuaaauacagugaagaggccaagcugaaccgagaagagaucgacggagugaaacuugaguccaccagaauuuaucaaauacuggcuaucuacagcacagucgcgucuucauuggugcucgucgugagucugggugcaauuagcuuuuggaugugcuccaauggcucuuuaaggugccggaucuguaucuga

SEQ ID NO: 127793 - RNA, 1701 nt, Artificial Sequence; identical to SEQ ID NO: 125786
  derived and/or modified sequence opt3 from hemagglutinin__InfluenzaA__ADM33004

SEQ ID NO: 127794 - RNA, 1701 nt, Artificial Sequence; identical to SEQ ID NO: 124685
  derived and/or modified sequence opt3 from hemagglutinin__InfluenzaA__ADM33023

SEQ ID NO: 127795 - RNA, 1701 nt, Artificial Sequence
  derived and/or modified sequence opt3 from hemagglutinin__InfluenzaA__ADM33040
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacggggucaaacuugaaucuacuaggaucuaucaaauucuggcuauauacucaaccguggcgaguagcuugguccucgugguuucccugggagcaaucucuuuuuggaugugcucgaacgguagcuuacggugccguauuuguaucuga

SEQ ID NO: 127796 - RNA, 1701 nt, Artificial Sequence
  derived and/or modified sequence opt3 from hemagglutinin__InfluenzaA__ADM33050
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuacucgucccuagguacgcuuuugccauggaacggaaugcaggguccggaaucauaauuagcgauaccccaguucaugacugcaacacaaccugucaaacgccgaaaggcgcuaucaauacuucgcugcccuuccagaacauucacccuaucacaaucgguaagugcccaaaguaugugaaaucuaccaagcugcgccuugccacuggguugagaaauguacccuccauucagucaaggggacucuuuggcgcgauagccggcuucaucgaagggggauggacagguaugguggacggcugguacggguaucaucaccagaacgaacaaggaaguggcuacgcagcugaucugaaaagcacccagaaugccauugacgagaucacgaacaaggucaauuccgugauagagaaaaugaacacccaguuuacagcuguugguaaggaguucaaucacuuagaaaagcggauugaaaaccugaauaaaaagguggaugacggguuccucgauaucuggacuuacaacgccgagcuucuggucuugcuagaaaaugagcgcacccuggacuaucaugauucuaacgugaaaaaccucuacgagaagguacgaagccagcugaaaaauaacgcaaaggaaaucggcaauggauguuuugaguucuaucacaagugcgacaacacauguauggaaucaguuaaaaauggcacuuacgauuauccuaaguacagugaggaagccaaacuuaacagagaggagauugacggggugaagcuggaauccaccaggaucuaucaaauuuuggcuauauacagcacagucgcgucuucacucgugcuggucgugaguuuaggagcaaucagcuuuuggaugugcuccaaugguucucugcggugccguauuuguaucuga

SEQ ID NO: 127797 - RNA, 1701 nt, Artificial Sequence
  derived and/or modified sequence opt3 from hemagglutinin__InfluenzaA__ADM33069
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccggagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacggugccguauuuguaucuga

SEQ ID NO: 127798 - RNA, 1701 nt, Artificial Sequence
  derived and/or modified sequence opt3 from hemagglutinin__InfluenzaA__ADM33079
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacggugccguauuuguaucuga

SEQ ID NO: 127799 - RNA, 1701 nt, Artificial Sequence
  derived and/or modified sequence opt3 from hemagglutinin__InfluenzaA__ADM33099
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuaauggucccuagguacgcuuuugccauggaacggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugaacaaggaagcggcuacgcagcugaucucaaauccacccagaacgccauugacgagaucacgaauaaggucaacucugugauagagaaaaugaauacccaguuuacagcuguugguaaggaguucaaccaccuggaaaagcggauugaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaaucggcaacggauguuuugaguucuaucacaagugcgacaauacauguauggaaaguguuaaaaacggcacuuacgauuauccuaaguacuccgaggaagccaaacugaauagagaggagauugacggggugaaacuugaaagcaccaggaucuaucaaauucuggcuauauacucuacagucgcgucaaguuuggugcucgucgugagccugggagcaaucuccuuuuggaugugcucuaacgguucguuacggugccguauuuguaucuga

SEQ ID NO: 127800 - RNA, 1701 nt, Artificial Sequence; identical to SEQ ID NO: 127799
  derived and/or modified sequence opt3 from hemagglutinin__InfluenzaA__ADM33109

SEQ ID NO: 127801 - RNA, 1701 nt, Artificial Sequence
  derived and/or modified sequence opt3 from hemagglutinin__InfluenzaA__ADM33128
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacggugccguauuuguaucuga

SEQ ID NO: 127802 - RNA, 1701 nt, Artificial Sequence; identical to SEQ ID NO: 127801
  derived and/or modified sequence opt3 from hemagglutinin__InfluenzaA__ADM33137

SEQ ID NO: 127803 - RNA, 1701 nt, Artificial Sequence; identical to SEQ ID NO: 127801
  derived and/or modified sequence opt3 from hemagglutinin__InfluenzaA__ADM33147

SEQ ID NO: 127804 - RNA, 1701 nt, Artificial Sequence; identical to SEQ ID NO: 127801
  derived and/or modified sequence opt3 from hemagglutinin__InfluenzaA__ADM33157

SEQ ID NO: 127805 - RNA, 1701 nt, Artificial Sequence
  derived and/or modified sequence opt3 from hemagglutinin__InfluenzaA__ADM33167
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagagaagaucgacggggucaaacuggagagcaccaggauuuaucaaauacuugcuaucuacucuacaguggcgucaagucuggucuuggugguuagccucggagcaauuuccuuuuggaugugcucuaacgguucgcugcggugccguaucuguaucuga

SEQ ID NO: 127806 - RNA, 1701 nt, Artificial Sequence; identical to SEQ ID NO: 126872
  derived and/or modified sequence opt3 from hemagglutinin__InfluenzaA__ADM33177

SEQ ID NO: 127807 - RNA, 1701 nt, Artificial Sequence; identical to SEQ ID NO: 127801
  derived and/or modified sequence opt3 from hemagglutinin__InfluenzaA__ADM33186

SEQ ID NO: 127808 - RNA, 1701 nt, Artificial Sequence; identical to SEQ ID NO: 127801
  derived and/or modified sequence opt3 from hemagglutinin__InfluenzaA__ADM33195

SEQ ID NO: 127809 - RNA, 1701 nt, Artificial Sequence; identical to SEQ ID NO: 127798
  derived and/or modified sequence opt3 from hemagglutinin__InfluenzaA__ADM33204

SEQ ID NO: 127810 - RNA, 1701 nt, Artificial Sequence
  derived and/or modified sequence opt3 from hemagglutinin__InfluenzaA__ADM33222
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaaaccagcucaagaauaacgcaaaagagaucggcaauggauguuuugaguucuaucauaagugcgacaacaccuguauggaaagugugaagaauggcacauacgauuauccuaaauacuccgaagaggccaagcugaacagagaggaaauugacggggucaaacuugagagcacuaggaucuaucagauucuggcuauauacucuaccguggcgucaaguuugguccucgugguuagccugggagcaaucuccuuuuggaugugcucuaaugguucguuacggugccguauuuguaucuga

SEQ ID NO: 127811 - RNA, 1701 nt, Artificial Sequence
  derived and/or modified sequence opt3 from hemagglutinin__InfluenzaA__ADM33232
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagacgaauacccaguuuacagcuguggguaaagaguucaaccaucuggaaaagcggauugagaauuuaaacaagaaagucgaugacggguuccuggauaucuggacuuacaaugccgaacuccuugugcuguuggagaacgagcgcacccuagacuaucacgauucaaauguaaagaaccuguacgaaaaaguucgaaaccagcucaagaauaacgcaaaagagaucggcaauggauguuuugaguucuaucauaagugcgacaacacauguauggaaagugugaagaauggcacuuacgauuauccuaaauacuccgaagaggccaagcugaacagagaggaaauugacggggucaaacuugagagcaccaggaucuaucagauucuggcuauauacucuacaguggcgucaaguuugguccucgugguuagccugggagcaaucuccuuuuggaugugcucuaaugguucguuacaaugccggauuuguaucuga

SEQ ID NO: 127812 - RNA, 1701 nt, Artificial Sequence
  derived and/or modified sequence opt3 from hemagglutinin__InfluenzaA__ADM33241
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaaggaaaacagcuacccaaaacucucuaaguccuauaucaaugacaagggaaaagagguauuaguucuguggggcauucaccaccccucaacgagcgcugaucaacagagucuuuaccagaacgccgacgcguacguguucgucgggucuucccgcuauagcaagaaauuuaagccugagaucacuauucgaccaaaagugcgugaucaggaaggcagaaugaauuacuauuggaccuugguggagcccggagacaagaucacauucgaagcaacugguaaccuggucguuccuagguacgccuuugcuauggagcggaacgccggcucggggauaauuaucucugauaccccagugcaugacugcaauacaaccugucaaacgccgaaaggagcaauuaacacuucccuacccuuccagaauauccacccuaucacaauuggcaagugcccaaaguauguaaaaucaaccaagcuccgccuggcuacuggucuuagaaacgugcccaguauacagagcagggggcuguuuggagccaucgcgggcuucauugaaggcggguggacaggaauggucgacgguugguacggcuaucaucaccagaaugagcaaggguccggauacgccgcagauuugaaaucuacccagaacgcuaucgacgagauaacgaauaaggugaacagcguuauugaaaagaugaauacccaguuuacagccgugggcaaagaguucaaccaccucgaaaagcggaucgagaaucugaacaaaaaggucgaugacgguuucuuagauaucuggacuuacaaugcugaacugcucgugcuucuggagaacgagcgcaccuuggacuaucaugauucaaauguuaaaaaccuauacgaaaagguacgaagucagcugaaaaacaaugccaaggagauugggaacggcuguuuugaguucuaucacaagugcgacaauacauguauggaauccgugaaaaacggaacuuacgauuauccuaaguacagcgaagaggcaaaacucaauagagaggaaaucgacggcgucaagcuggagucuaccaggauuuaucaaauacuugccaucuacucaacaguggcuaguagccuggucuuggugguuucccucggggcgauuucuuuuuggaugugcucgaacggaagccugcggugccguaucuguaucuga

SEQ ID NO: 127813 - RNA, 1701 nt, Artificial Sequence; identical to SEQ ID NO: 127810
  derived and/or modified sequence opt3 from hemagglutinin__InfluenzaA__ADM33251

SEQ ID NO: 127814 - RNA, 1701 nt, Artificial Sequence
  derived and/or modified sequence opt3 from hemagglutinin__InfluenzaA__ADM33260
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggagacagcuacccaaaacucucuaaguccuauaucaacgauaagggcaaagaaguauuaguucuguggggcauucaccaccccucaacgagcgcugaccaacagagucuuuaccagaaugccgaugcguacguguucgucgggucuucccgcuauagcaagaaauuuaagccugagaucgcaauucgaccaaaagugcgugaccaggagggaagaaugaacuacuauuggacuuugguggaacccggugauaagaucaccuucgaggccacaggcaaucuggucguuccuagguacgcuuuugccauggaacggaacgcagggucgggaauaauuaucucugacacuccagugcaugacugcaacaccacaugucaaaccccgaaaggcgcuauuaauacgucccuacccuuccagaacauccacccuaucacuauugguaagugcccaaaguauguaaaaucaacaaagcuccgccuggccaccgggcuuagaaaugugcccaguauacagagcaggggacuguuuggcgcgaucgccggcuucauugaagggggauggacugguauggucgauggcugguacggguaucaucaccagaacgaacaaggauccggcuacgcagcugacuugaaaucuacacagaaugccaucgaugagauaaccaacaaggugaauagcguuauugagaaaaugaacacgcaguuuaccgcuguggguaaggaguucaaucaccucgagaagcggaucgaaaaccugaauaaaaaggucgacgauggguucuuagacaucuggacauacaacacugagcugcucgugcuucuggaaaaugagcgcaccuuggauuaucaugacucaaacguuaaaaaucuauacgagaagguacgaagucagcugaaaaacaacgccaaggaaauuggcaauggauguuuugaguucuaucacaagugcgauaacacauguauggaauccgugaaaaauggcacuuacgacuauccuaaguacagcgaggaagcaaaacucaacagagaggagaucgauggggucaagcuggaaucuaccaggauuuaucaaauacuugccaucuacucaacaguggcuaguagccuggucuuggugguuucccucggagcgauuucuuuuuggaugugcucgaaugguagccugcggugccguaucuguaucuga

SEQ ID NO: 127815 - RNA, 1701 nt, Artificial Sequence
  derived and/or modified sequence opt3 from hemagglutinin__InfluenzaA__ADM33280
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacaguuaguagcugguccuacaucguggagaccucuucgucagacaacggaacuugcuauccaggcgauuuuauugacuacgaagaguugagggagcagcucagcagugucuccucuuucgaacgguuugagaucuucccgaagacaagcuccuggcccaaucacgauucaaacaagggugugaccgcagccuguccucaugcuggggcaaaaaguuuuuauaagaaucugauauggcugguuaaaaagggaaacagcuacccaaaacucucuaaguccuauaucaaugacaagggcaaagaaguauuagugcuguggggcauucaccaccccucaacgagcgccgaucaacagagucuuuaccagaacgcugacgccuacgucuucguggggucuucccgcuauagcaagaaauuuaagccugagaucgcgauucgaccaaaagugcgugaucaggagggaagaaugaauuacuauuggacuuuggucgaacccggugacaagaucaccuucgaggcaacaggcaaccugguugugccuagguacgccuuugcuauggaacggaacgccgggucgggaauaauuaucucugauacuccaguacaugacugcaauaccacaugucaaaccccgcgcggcgcaauuaacacgucccuacccuuccagaauauccacccuaucacuauugguaaaugcccaaaguaugugaagucaacaaaacucagacuggcuaccgggcuuaggaacguccccaguauacagagccggggacuguuuggcgccaucgcgggcuucauugaagggggauggacugguaugguggacggcugguacggguaucaucaccagaaugaacaaggauccggcuacgccgcagauuugaagucuacacagaacgcuaucgacgagauaaccaauaaaguuaacagcgugauugagaagaugaauacgcaguuuaccgccgucgguaaagaguucaaccaccucgagaagcgcaucgaaaaucugaacaagaaaguggaugacggguucuuagauaucuggacauacaaugcugagcugcucguacuucuggaaaacgagcgaacuuuggacuaucaugauucaaauguuaagaaccuauacgagaaagugagaagucagcugaagaacaaugccaaagaaauuggcaacggauguuuugaguucuaucacaagugcgacaauaccuguauggaauccgucaagaacggcacauacgauuauccuaaauacagcgaggaagcaaagcucaauagggaggagaucgacggggugaaacuggaaucuacucggauuuaucaaauacuugccaucuacucaaccgucgcuaguagccugguguugguugugucccucggagcgauuucuuuuuggaugugcucgaacgguagccugcagugccguaucuguaucuga

SEQ ID NO: 127816 - RNA, 1701 nt, Artificial Sequence; identical to SEQ ID NO: 125132
  derived and/or modified sequence opt3 from hemagglutinin__InfluenzaA__ADM33290

SEQ ID NO: 127817 - RNA, 1701 nt, Artificial Sequence; identical to SEQ ID NO: 124685
  derived and/or modified sequence opt3 from hemagglutinin__InfluenzaA__ADM33300

SEQ ID NO: 127818 - RNA, 1701 nt, Artificial Sequence; identical to SEQ ID NO: 124672
  derived and/or modified sequence opt3 from hemagglutinin__InfluenzaA__ADM33310

SEQ ID NO: 127819 - RNA, 1701 nt, Artificial Sequence
  derived and/or modified sequence opt3 from hemagglutinin__InfluenzaA__ADM33320
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccuuuucuucggacaacggaacuugcuauccaggcgauuucaucgacuacgaagaguugagggagcagcucucaagcgugaguuccuuugaacgguucgagauuuuuccgaagacaucuagcuggcccaaucacgauuccaacaagggugucaccgccgcuuguccucaugcaggggccaaaucauucuauaagaaucugaucuggcuggugaaaaagggaaacaguuacccaaaacucagcaagucuuauauaaaugacaagggcaaagaaguauuaguucuguggggcauccaccaccccuccacgucagcugaucaacagagccuuuaccagaacgccgacgcguacguguuugucgggaguucucgcuauuccaagaaauucaagccugagauugcaauccgaccaaaagugcgugaucaggagggaagaaugaauuacuauuggacuuugguggaacccggugacaagauuaccuuugaggccacaggcaaccuggucguuccuagguacgcuuucgccauggaacggaacgcagggagcggaaucauaauuucggauacuccagugcaugacugcaauaccacaugucaaaccccgaaaggcgcuaucaacacgucucuacccuuucagaauauucacccuaucacuaucgguaagugcccaaaguauguaaaauccacaaagcuccgccuggccaccgggcuuagaaacgugcccucaauucagaguaggggacuguucggcgcgauagccggcuuuaucgaagggggauggacugguauggucgacggcugguacggguaucaucaccagaaugaacaaggaagcggcuacgcagcugauuugaaauccacacagaacgccauugacgagaucaccaauaaggugaacucuguuauagagaaaaugaauacgcaguucaccgcuguggguaaggaguucaaccaccucgagaagcggauugaaaaucugaacaaaaaggucgaugacggguuuuuagauaucuggacauacaaugccgagcugcucgugcuucuggaaaacgagcgcacuuuggacuaucaugauagcaauguuaaaaaccuauacgagaagguacgaucacagcugaaaaacaaugcaaaggaaaucggcaacggauguuucgaguuuuaucacaagugcgacaauaccuguauggaaagugugaaaaacggcacauacgauuauccuaaguacuccgaggaagccaaacucaauagagaggagauugacggggucaagcuggaaagcacuaggaucuaucaaauucuugcuauauacucuaccguggcgucaagucuggucuuggugguuagccucggagcaaucuccuucuggaugugcucuaacgguucgcugcagugccggauuuguaucuga

SEQ ID NO: 127820 - RNA, 1701 nt, Artificial Sequence; identical to SEQ ID NO: 124711
  derived and/or modified sequence opt3 from hemagglutinin__InfluenzaA__ADM33340

SEQ ID NO: 127821 - RNA, 1701 nt, Artificial Sequence
  derived and/or modified sequence opt3 from hemagglutinin__InfluenzaA__ADM33355
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcauaauugcaacaccacaugucaaaccccgaaaggcgcuaucaauacgucccuacccuuccagaacauucacccuaucacuaucgguaagugcccaaaguauguaaaaucaacaaagcuccgccuggccaccgggcuuagaaaugugcccaguauucagagcaggggacuguuuggcgcgauagccggcuucaucgaagggggauggacugguauggucgacggcugguacggguaucaucaccagaacgaacaaggauccggcuacgcagcugacuugaaaucuacacagaaugccauugaugagaucaccaacaaggugaauagcguuauagagaaaaugaacacgcaguuuaccgcuguggguaaggaguucaaucaccucgagaagcggauugaaaaccugaauaaaaaggucgacgauggguucuuagacaucuggacauacaacgccgagcugcucgugcuucuggaaaaugagcgcacuuuggauuaucaugacucaaacguuaaaaaccuauacgagaagguacgaagucagcugaaaaauaacgcaaaggaaaucggcaauggauguuuugaguucuaucacaagugcgauaacaccuguauggaauccgugaaaaauggcacauacgacuauccuaaguacagcgaggaagccaaacucaacagagaggagauugauggggucaagcuggaaucuacuaggaucuaucaaauucuugcuauauacucaaccguggcgaguagccuggucuuggugguuucccucggagcaaucucuuuuuggaugugcucgaaugguagccugcagugccggauuuguaucuga

SEQ ID NO: 127822 - RNA, 1701 nt, Artificial Sequence; identical to SEQ ID NO: 127821
  derived and/or modified sequence opt3 from hemagglutinin__InfluenzaA__ADM33365

SEQ ID NO: 127823 - RNA, 1701 nt, Artificial Sequence; identical to SEQ ID NO: 124711
  derived and/or modified sequence opt3 from hemagglutinin__InfluenzaA__ADM33375

SEQ ID NO: 127824 - RNA, 1701 nt, Artificial Sequence
  derived and/or modified sequence opt3 from hemagglutinin__InfluenzaA__ADM33385
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccuccaaaggcgcuaucaacacgucacuaccguuccagaauauucaccccaucacuaucgguaagugcccuaaguauguaaaaaguacaaagcuccgccuggccaccgggcuuagaaacgugccaagcauucaguccaggggacuguuuggcgcgauagccggcuucaucgaagggggauggacugguauggucgacggcugguacggguaucaucaccagaaugaacaaggaucuggcuacgcagcugauuugaaaagcacacagaacgccauugacgagaucaccaauaaggugaacucaguuauagagaaaaugaauacgcaguuuaccgcuguggguaaggaguucaaccaccucgagaagcggauugaaaaucugaacaaaaaggucgaugacggguucuuagauaucuggacauacaaugccgagcugcucgugcuucuggaaaacgagcgcacuuuggacuaucaugauaguaauguuaaaaaccuauacgagaagguacgaucccagcugaaaaacaaugcaaaggaaaucggcaacggauguuuugaguucuaucacaagugcgacaauaccuguauggaaagcgugaaaaacggcacauacgauuaucccaaguacucugaggaagccaaacucaauagagaggagauugacggggucaagcuggaaucaacuaggaucuaucaaauucuugcuauauacaguaccguggcgagcucccuggucuuggugguuucucucggagcaaucucguuuuggaugugcagcaacgguucccugcagugccggauuuguaucuga

SEQ ID NO: 127825 - RNA, 1701 nt, Artificial Sequence; identical to SEQ ID NO: 125132
  derived and/or modified sequence opt3 from hemagglutinin__InfluenzaA__ADM33395

SEQ ID NO: 127826 - RNA, 1701 nt, Artificial Sequence; identical to SEQ ID NO: 125132
  derived and/or modified sequence opt3 from hemagglutinin__InfluenzaA__ADM33405

SEQ ID NO: 127827 - RNA, 1701 nt, Artificial Sequence; identical to SEQ ID NO: 127821
  derived and/or modified sequence opt3 from hemagglutinin__InfluenzaA__ADM33415

SEQ ID NO: 127828 - RNA, 1701 nt, Artificial Sequence; identical to SEQ ID NO: 125528
  derived and/or modified sequence opt3 from hemagglutinin__InfluenzaA__ADM33425

SEQ ID NO: 127829 - RNA, 1701 nt, Artificial Sequence
  derived and/or modified sequence opt3 from hemagglutinin__InfluenzaA__ADM34007
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggaggagcccggugacaagauuacauucgaagccacuggcaaccuaguggucccuagguacgcuuuugccauggagcggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacgagaucacgaauaaggucaacucugugauagaaaagaugaauacccaguuuacagcuguugguaaggaguucaaccaccuggaaaagcggauugagaauuuaaacaaaaagguggaugacggguuccuggauaucuggacuuacaaugccgaacuccuuguccuguuggagaacgagcgcacccuagacuaucaugauagcaaugugaaaaaccuguacgaaaagguacgaucacagcucaaaaacaaugcaaaggagaucggcaacggauguuuugaguucuaucacaagugcgacaauacauguauggaaaguguuaaaaacggcacuuacgauuauccuaaguacuccgaagaggccaaacugaauagagaggaaauugacggggugaaacuugagagcaccaggaucuaucaaauucuggcuauauacucuacagucgcgucaaguuuggugcucgucgugagccugggagcaaucuccuuuuggaugugcucuaacgguucguuacagugccggauuuguaucuga

SEQ ID NO: 127830 - RNA, 1701 nt, Artificial Sequence; identical to SEQ ID NO: 124685
  derived and/or modified sequence opt3 from hemagglutinin__InfluenzaA__ADM52443

SEQ ID NO: 127831 - RNA, 1701 nt, Artificial Sequence
  derived and/or modified sequence opt3 from hemagglutinin__InfluenzaA__ADM52453
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccaauucaugacugcaauaccacaugucaaaccccgaaaggcgcuaucaacacgucccuacccuuccagaaugugcacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 127832 - RNA, 1701 nt, Artificial Sequence
  derived and/or modified sequence opt3 from hemagglutinin__InfluenzaA__ADM52473
augaaggccauccuggcugugcuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucaggaaacggcacuugcuauccaggugacuuuaucgauuacgaagaacucagggagcagcugagcaguguuuccucuuucgaacgguuugagauuuucccgaagacaagcuccuggcccaaucacgacucaaacaagggggugaccgcugcauguccucaugccggagcuaaaaguuuuuauaagaaucugcucugguuagucaaaaagggcaacagcuacccaaaacugucuaaguccuauaucaaugauaagggcaaagaagugcuuguauugugggggauacaccaccccucaacgagcgccgaccaacagagucuguaccagaacgcggaugcauacguuuucgugggaacuucucgcuauuccaagaaauuuaagccugagaucgccauucgaccaaaaguccgugaccaggaggguagaaugaauuacuauuggacccuagugggccccggggauaagaucacauucgaagcuacuggaaaccucguggucccuagguacgccuuugcaauggagcggaacgcuggcagcgguauuaucauaucggacaccccaguucaugauugcaauacaaccugucaaacgccgaaaggggccauuaacacuucucugcccuuccagaauauccacccuauuacaaucggaaagugcccaaaguaugugaaauccaccaaacuucgccuggcgacuggcuugagaaacguacccucaauccagaguaggggccucuuuggggccauugcaggauucauagaagguggcuggacagggaugguggacggaugguacggcuaucaucaccagaaugagcaagguagcggguacgcugccgaccugaaguccacccagaacgcuaucgaugaaauuacgaauaaggucaacucugugaucgagaaaaugaauacccaguuuacagccguuggcaaggaguucaaccacuuagaaaagcggauagagaaucugaacaaaaagguggacgauggauuccucgacauuuggacuuacaaugcagaacuucuggucuugcuagagaacgaacgcacccuggauuaucaugacagcaaugugaaaaaccucuacgagaagguacgaucacagcugaaaaacaaugccaaggagaucggcaacggguguuuugaguucuaucacaagugcgauaauacauguauggagaguguuaaaaacggaacuuacgacuauccuaaguacuccgaagaggcuaaacuuaauagagaagagaucgauggugugaagcuggagagcaccaggauuuaucaaaucuuggcgauuuacucuacagucgcaucaagucucgugcuggucgugagcuuaggcgccauauccuuuuggaugugcucuaacgggucgcugcagugccggaucuguauuuga

SEQ ID NO: 127833 - RNA, 1701 nt, Artificial Sequence; identical to SEQ ID NO: 125849
  derived and/or modified sequence opt3 from hemagglutinin__InfluenzaA__ADM52483

SEQ ID NO: 127834 - RNA, 1701 nt, Artificial Sequence; identical to SEQ ID NO: 124865
  derived and/or modified sequence opt3 from hemagglutinin__InfluenzaA__ADM52493

SEQ ID NO: 127835 - RNA, 1701 nt, Artificial Sequence; identical to SEQ ID NO: 124865
  derived and/or modified sequence opt3 from hemagglutinin__InfluenzaA__ADM52513

SEQ ID NO: 127836 - RNA, 1701 nt, Artificial Sequence; identical to SEQ ID NO: 124865
  derived and/or modified sequence opt3 from hemagglutinin__InfluenzaA__ADM52524

SEQ ID NO: 127837 - RNA, 1701 nt, Artificial Sequence; identical to SEQ ID NO: 124865
  derived and/or modified sequence opt3 from hemagglutinin__InfluenzaA__ADM52534

SEQ ID NO: 127838 - RNA, 1701 nt, Artificial Sequence; identical to SEQ ID NO: 124865
  derived and/or modified sequence opt3 from hemagglutinin__InfluenzaA__ADM52554

SEQ ID NO: 127839 - RNA, 1701 nt, Artificial Sequence; identical to SEQ ID NO: 124865
  derived and/or modified sequence opt3 from hemagglutinin__InfluenzaA__ADM52564

SEQ ID NO: 127840 - RNA, 1701 nt, Artificial Sequence; identical to SEQ ID NO: 124672
  derived and/or modified sequence opt3 from hemagglutinin__InfluenzaA__ADM52574

SEQ ID NO: 127841 - RNA, 1701 nt, Artificial Sequence; identical to SEQ ID NO: 124685
  derived and/or modified sequence opt3 from hemagglutinin__InfluenzaA__ADM52584

SEQ ID NO: 127842 - RNA, 1701 nt, Artificial Sequence
  derived and/or modified sequence opt3 from hemagglutinin__InfluenzaA__ADM52594
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagaacaaugcaaaagagaucggcaacggauguuuugaguucuaucacaagugcgacaauacauguauggaaagugugaaaaacggcacuuacgauuauccuaaguacuccgaagaggccaaacugaaucgagaagagauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 127843 - RNA, 1701 nt, Artificial Sequence; identical to SEQ ID NO: 124865
  derived and/or modified sequence opt3 from hemagglutinin__InfluenzaA__ADM52604

SEQ ID NO: 127844 - RNA, 1701 nt, Artificial Sequence; identical to SEQ ID NO: 124865
  derived and/or modified sequence opt3 from hemagglutinin__InfluenzaA__ADM52614

SEQ ID NO: 127845 - RNA, 1701 nt, Artificial Sequence; identical to SEQ ID NO: 126457
  derived and/or modified sequence opt3 from hemagglutinin__InfluenzaA__ADM52624

SEQ ID NO: 127846 - RNA, 1701 nt, Artificial Sequence; identical to SEQ ID NO: 124865
  derived and/or modified sequence opt3 from hemagglutinin__InfluenzaA__ADM52634

SEQ ID NO: 127847 - RNA, 1701 nt, Artificial Sequence; identical to SEQ ID NO: 124865
  derived and/or modified sequence opt3 from hemagglutinin__InfluenzaA__ADM52644

SEQ ID NO: 127848 - RNA, 1701 nt, Artificial Sequence; identical to SEQ ID NO: 124865
  derived and/or modified sequence opt3 from hemagglutinin__InfluenzaA__ADM52654

SEQ ID NO: 127849 - RNA, 1701 nt, Artificial Sequence; identical to SEQ ID NO: 126273
  derived and/or modified sequence opt3 from hemagglutinin__InfluenzaA__ADM52664

SEQ ID NO: 127850 - RNA, 1701 nt, Artificial Sequence; identical to SEQ ID NO: 126457
  derived and/or modified sequence opt3 from hemagglutinin__InfluenzaA__ADM52674

SEQ ID NO: 127851 - RNA, 1701 nt, Artificial Sequence; identical to SEQ ID NO: 124865
  derived and/or modified sequence opt3 from hemagglutinin__InfluenzaA__ADM52684

SEQ ID NO: 127852 - RNA, 1701 nt, Artificial Sequence; identical to SEQ ID NO: 126457
  derived and/or modified sequence opt3 from hemagglutinin__InfluenzaA__ADM52704

SEQ ID NO: 127853 - RNA, 1701 nt, Artificial Sequence; identical to SEQ ID NO: 126273
  derived and/or modified sequence opt3 from hemagglutinin__InfluenzaA__ADM52714

SEQ ID NO: 127854 - RNA, 1701 nt, Artificial Sequence
  derived and/or modified sequence opt3 from hemagglutinin__InfluenzaA__ADM86399
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuguaaacacgucccuacccuuccagaauauucacccuaucacuaucgguaagugcccaaaguaugugaaaucaacaaagcuccgccuggccaccgggcuuagaaacguccccaguauucagagcaggggacuguuuggcgcgauagccggcuucaucgaagggggauggacugguaugguggacggcugguacggguaucaucaccagaaugaacaaggauccggcuacgcagcugauuugaaaucuacacagaacgccauugacgagaucaccaauaagguuaacagcgugauagagaaaaugaauacgcaguuuaccgcugucgguaaggaguucaaccaccucgagaagcggauugaaaaucugaacaaaaagguggaugacggguucuuagauaucuggacauacaaugccgagcugcucguacuucuggaaaacgagcgcacuuuggacuaucaugauucaaauguuaaaaaccuauacgagaaggugcgaagucagcugaaaaacaaugcaaaggaagucggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauccuugcuauuuacucaaccgcggcaaguagccugguguugguugugucccucggagccauaucuuuuuggaugugcucgaacgguagccugcagugccggaucuguauuuga

SEQ ID NO: 127855 - RNA, 1701 nt, Artificial Sequence; identical to SEQ ID NO: 124685
  derived and/or modified sequence opt3 from hemagglutinin__InfluenzaA__ADM86409

SEQ ID NO: 127856 - RNA, 1701 nt, Artificial Sequence; identical to SEQ ID NO: 124685
  derived and/or modified sequence opt3 from hemagglutinin__InfluenzaA__ADM86419

SEQ ID NO: 127857 - RNA, 1701 nt, Artificial Sequence; identical to SEQ ID NO: 126334
  derived and/or modified sequence opt3 from hemagglutinin__InfluenzaA__ADM86440

SEQ ID NO: 127858 - RNA, 1701 nt, Artificial Sequence; identical to SEQ ID NO: 124685
  derived and/or modified sequence opt3 from hemagglutinin__InfluenzaA__ADM86450

SEQ ID NO: 127859 - RNA, 1707 nt, Artificial Sequence
  derived and/or modified sequence opt3 from hemagglutinin__InfluenzaA__ADM95450
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggccaucgcaugaggcuucacugggagugagcgccgcaugucccuaccagggcaaaaguuccuucuuucggaacguaguuuggcugaucaagaaaaauaacacauauccuacuauaaagcgcucuuacaauaacaccaaucaagaagaccucuuagugaugugggguauucaccacccaaacgaugccgcugagcagacaaaccuguaucagaaucccaccacuuacaucagcgucgggacauccacccuuaaccagcgauugacgccucguauugcaacuagaucaaaggugaauggacaaaguggcaggauggaguucuuuuggaccauccugaaaccaaacgacgccaucaauuucgaaagcaacggcaauuuuauugcuccggaauacgccuauaagauagugaaaaagggggauucuacaaucaugaaauccgagcuagaauacggaaacugcaauacuaagugucagacccccaugggugcgauuaacucaagcaugccuuuccauaauauccacccacucacaauaggcgagugccccaaauaugucaagaguaaccggcugguucuugcaaccgggcugcgcaauucuccucagagagagggaaggcggaagaaacgcggcuuguuuggugccauugcuggguucaucgaaggaggcuggcagggcaugguggacgggugguacggauaucaucacuccaacgagcaagguagcggcuacgccgcagacaaggaaucgacgcagaaagcuaucgaugggguaacuaauaaggugaacucuauuaucgacaaaaugaacacacaguuugaggccgucggacgagaguucaauaaccucgaaagaaggauugagaaucugaacaagaagauggaagauggcuucuuagacguguggaccuauaaugcggagcugcucguucuuauggaaaacgagcggacucuggauuuucacgacuccaaugugaaaaacuuguacgauaagguccgucuacaacugcgcgacaaugccaaagaacucgguaacggguguuucgaguuuuaccauaagugcgauaaugaguguauggaaucagugagaaacggcacauaugacuacccacaguauagugaggaagcaaggcugaaacgggaggagauaagcggaguaaaacuugaauccaucggcauuuaccagauccugucuaucuauagcaccguugcuucaaguuuggcccucgcuauuaugguggccgggcuguccuuauggaugugcagcaauggaucucugcagugccgaauauguaucuga

SEQ ID NO: 127860 - RNA, 1701 nt, Artificial Sequence; identical to SEQ ID NO: 124685
  derived and/or modified sequence opt3 from hemagglutinin__InfluenzaA__ADM95745

SEQ ID NO: 127861 - RNA, 1701 nt, Artificial Sequence; identical to SEQ ID NO: 124685
  derived and/or modified sequence opt3 from hemagglutinin__InfluenzaA__ADM95746

SEQ ID NO: 127862 - RNA, 1701 nt, Artificial Sequence; identical to SEQ ID NO: 124685
  derived and/or modified sequence opt3 from hemagglutinin__InfluenzaA__ADM95747

SEQ ID NO: 127863 - RNA, 1701 nt, Artificial Sequence; identical to SEQ ID NO: 124685
  derived and/or modified sequence opt3 from hemagglutinin__InfluenzaA__ADM95749

SEQ ID NO: 127864 - RNA, 1701 nt, Artificial Sequence
  derived and/or modified sequence opt3 from hemagglutinin__InfluenzaA__ADM95750
augaaggccauccuggugguccuccuuuacaccuucgcuacagcaaacgccgacacucugugcauuggcuaucacgcgaauaacagcacggauaccguugacacaguguuggagaagaauguaacugugacccauuccuuuaacuuacuggaagauaagcacaaugggaaacuauguaagcucagaggagucgcuccccugcaucuugguaaaugcaacauagccggcuggauccuggggaauccugagugugaaucuuugucaacagcaaguagcugguccuacauuguggagaccucuucgucagacaacggaacuugcuauccaggcgauuucaucgacuacgaggagcucagggagcagcugagcaguguuuccucuuuugaacgguucgagauuuuuccgaagacaagcuccuggcccaaucacgauucaaacaagggugugaccgccgcuuguccucaugcaggggccaaaaguuucuauaagaaucugaucuggcucgucaaaaagggaagcucuuacccaaaauuauccaagucauauauaaacgacaagggcaaagaagugcugguacuuuggggcauccaccaccccagcacgagugcugaucaacagucuuuguaccagaaugccgacgcguacguuuuugugggguccagccgcuauucgaagaaauucaagccugagauugcaauccgaccaaaaguccgugaucaggagggaagaaugaacuacuauuggacucugguggaacccggugacaagauuaccuuugaggccacaggcaaucuaguggucccuagguacgcuuucgccauggaacggaacgcagggucuggaaucauaauuuccgauacuccaguucaugacugcaacaccacaugucaaaccccgaaaggcgcuaucaauacgucacuccccuuucagaacauucacccuaucacuaucgguaagugcccaaaguaugugaaaaguacaaagcugcgccuugccaccgggcugagaaauguacccagcauucaguccaggggauuguucggcgcgauagccggcuuuaucgaagggggauggacugguaugguggacggcugguacggguaucaucaccagaacgaacaaggaucuggcuacgcagcugaucucaaaagcacacagaaugccauugacgagaucaccaacaaggucaauucagugauagagaaaaugaacacgcaguucaccgcuguugguaaggaguucaaucaccuggaaaagcggauugaaaacuuaaauaaaaagguggaugacggguuucuggauaucuggacauacaacgccgagcuccuuguccuguuggaaaaugagcgcacucuagacuaucaugauaguaacgugaaaaaucuguacgagaagguacgaucccagcucaaaaacaacgcaaaggaaaucggcaauggauguuucgaguuuuaucacaagugcgacaacaccuguauggaaagcguuaaaaauggcacauacgauuauccuaaguacucugaggaagccaaacugaacagagaggagauugacggggugaaacuugaaucaacuaggaucuaucaaauucuggcuauauacaguaccgucgcgagcuccuuggugcucgucgugucucugggagcaaucucguucuggaugugcagcaaugguuccuuacagugccggauuuguaucuga

SEQ ID NO: 127865 - RNA, 1701 nt, Artificial Sequence; identical to SEQ ID NO: 124685
  derived and/or modified sequence opt3 from hemagglutinin__InfluenzaA__ADM95751

SEQ ID NO: 127866 - RNA, 1701 nt, Artificial Sequence; identical to SEQ ID NO: 124685
  derived and/or modified sequence opt3 from hemagglutinin__InfluenzaA__ADM95752

SEQ ID NO: 127867 - RNA, 1701 nt, Artificial Sequence; identical to SEQ ID NO: 124685
  derived and/or modified sequence opt3 from hemagglutinin__InfluenzaA__ADM95753

SEQ ID NO: 127868 - RNA, 1701 nt, Artificial Sequence; identical to SEQ ID NO: 124685
  derived and/or modified sequence opt3 from hemagglutinin__InfluenzaA__ADM95754

SEQ ID NO: 127869 - RNA, 1701 nt, Artificial Sequence; identical to SEQ ID NO: 124685
  derived and/or modified sequence opt3 from hemagglutinin__InfluenzaA__ADM95755

SEQ ID NO: 127870 - RNA, 1701 nt, Artificial Sequence; identical to SEQ ID NO: 124865
  derived and/or modified sequence opt3 from hemagglutinin__InfluenzaA__ADM95757

SEQ ID NO: 127871 - RNA, 1701 nt, Artificial Sequence; identical to SEQ ID NO: 124685
  derived and/or modified sequence opt3 from hemagglutinin__InfluenzaA__ADM95758

SEQ ID NO: 127872 - RNA, 1701 nt, Artificial Sequence
  derived and/or modified sequence opt3 from hemagglutinin__InfluenzaA__ADM95759
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacuauggaacuugcuacccaggcgauuuuaucgacuaugaggagcucagggagcagcugagcaguguguccucuuucgaacgguuugagauuuucccgaagacaagcuccuggcccaaccacgauucaaauaagggugucaccgccgcuuguccucaugcaggggccaaaaguuuuuacaagaaccugaucuggcucgugaaaaagggaaauagcuauccaaaauuaucuaaguccuacauaaacgacaagggcaaagaaguacugguucuuuggggcauccaccaccccucaacgagcgcugaucaacagaguuuguaccagaaugccgacgcguauguguucgucgggacuucucgcuacuccaagaaauuuaagccugagauugcaauccgaccaaaagugcgugaucaggagggaagaaugaacuauuacuggacccugguggaacccggugacaagauuacauucgaggccacuggcaaucuagucguuccuagguaugcuuuugccauggaacggaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguacguaaaauccaccaagcugcgccuugccacugggcugagaaaugugcccucaauucagaguaggggauuguuuggcgcgauagccggcuucaucgaagggggauggacagguauggucgacggcugguauggguaccaucaccagaacgaacaaggaagcggcuacgcagcugaucucaaauccacccagaaugccauugacgagaucacgaacaagguaaauucuguuauagagaaaaugaacacccaguuuacagcuguggguaaggaguucaaucaccuggaaaagcggauugaaaacuuaaauaaaaaggucgaugacggguuccuggauaucuggacuuauaacgccgagcuccuugugcuguuggaaaaugagcgcacccuagacuaccaugauagcaacgugaaaaaucuguaugagaagguucgaucacagcucaaaaacaacgcaaaggaaaucggcaauggauguuuugaguucuaccacaagugcgacaacacauguauggaaagugugaaaaauggcacuuaugauuacccuaaguauuccgaggaagccaaacugaacagagaggagauugacggggucaaacuugaaagcaccaggaucuaccaaauucuggcuauauacucuacaguggcgucaaguuugguccucgugguuagccugggagcaaucuccuuuuggaugugcucuaaugguucguuacagugccggauuuguaucuga

SEQ ID NO: 127873 - RNA, 1701 nt, Artificial Sequence; identical to SEQ ID NO: 124672
  derived and/or modified sequence opt3 from hemagglutinin__InfluenzaA__ADM95760

SEQ ID NO: 127874 - RNA, 1701 nt, Artificial Sequence; identical to SEQ ID NO: 124685
  derived and/or modified sequence opt3 from hemagglutinin__InfluenzaA__ADM95761

SEQ ID NO: 127875 - RNA, 1701 nt, Artificial Sequence
  derived and/or modified sequence opt3 from hemagglutinin__InfluenzaA__ADM95763
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagaauaacgggaaacuauguaagcucagaggaguggcuccccugcaccuugguaaaugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaagacaagcuccuggcccaaccaugauucaaauaagggugucaccgccgcuuguccucacgcaggggccaaaaguuuuuauaagaaccugaucuggcucgugaaaaagggaaauagcuacccaaaauuaucuaaguccuauauaaacgacaagggcaaagaaguacugguucuuuggggcauccaucaccccucaacgagcgcugaucaacagaguuuguaccagaaugccgacgcguacguguucgucgggucuucccgcuauagcaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggucgggaaucauaauuucugauacuccagugcacgacugcaacaccacaugucaaaccccgaaaggcgcuaucaauacgucccuccccuuccagaacauucauccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgacggcugguacggguaucaccaucagaacgaacaaggauccggcuacgcagcugaucucaaaucuacacagaaugccauugacgagaucaccaacaaggugaauagcguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucacgauucaaacguaaagaaccuguacgagaagguucgaagucagcucaaaaauaacgcaaaggaaaucggcaauggauguuuugaguucuaucauaagugcgacaacaccuguauggaauccgugaaaaauggcacauacgauuauccuaaguacagcgaggaagccaaacugaacagagaggagauugacggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 127876 - RNA, 1701 nt, Artificial Sequence; identical to SEQ ID NO: 124685
  derived and/or modified sequence opt3 from hemagglutinin__InfluenzaA__ADM95764

SEQ ID NO: 127877 - RNA, 1701 nt, Artificial Sequence; identical to SEQ ID NO: 124685
  derived and/or modified sequence opt3 from hemagglutinin__InfluenzaA__ADM95765

SEQ ID NO: 127878 - RNA, 1701 nt, Artificial Sequence; identical to SEQ ID NO: 124685
  derived and/or modified sequence opt3 from hemagglutinin__InfluenzaA__ADM95767

SEQ ID NO: 127879 - RNA, 1701 nt, Artificial Sequence; identical to SEQ ID NO: 125528
  derived and/or modified sequence opt3 from hemagglutinin__InfluenzaA__ADM95768

SEQ ID NO: 127880 - RNA, 1701 nt, Artificial Sequence; identical to SEQ ID NO: 125038
  derived and/or modified sequence opt3 from hemagglutinin__InfluenzaA__ADM95769

SEQ ID NO: 127881 - RNA, 1701 nt, Artificial Sequence; identical to SEQ ID NO: 126801
  derived and/or modified sequence opt3 from hemagglutinin__InfluenzaA__ADM95771

SEQ ID NO: 127882 - RNA, 1701 nt, Artificial Sequence; identical to SEQ ID NO: 124685
  derived and/or modified sequence opt3 from hemagglutinin__InfluenzaA__ADM95772

SEQ ID NO: 127883 - RNA, 1701 nt, Artificial Sequence; identical to SEQ ID NO: 124685
  derived and/or modified sequence opt3 from hemagglutinin__InfluenzaA__ADM95774

SEQ ID NO: 127884 - RNA, 1701 nt, Artificial Sequence; identical to SEQ ID NO: 124685
  derived and/or modified sequence opt3 from hemagglutinin__InfluenzaA__ADM95775

SEQ ID NO: 127885 - RNA, 1701 nt, Artificial Sequence; identical to SEQ ID NO: 125038
  derived and/or modified sequence opt3 from hemagglutinin__InfluenzaA__ADM95776

SEQ ID NO: 127886 - RNA, 1701 nt, Artificial Sequence; identical to SEQ ID NO: 125038
  derived and/or modified sequence opt3 from hemagglutinin__InfluenzaA__ADM95778

SEQ ID NO: 127887 - RNA, 1701 nt, Artificial Sequence
  derived and/or modified sequence opt3 from hemagglutinin__InfluenzaA__ADM95779
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaccaaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 127888 - RNA, 1701 nt, Artificial Sequence; identical to SEQ ID NO: 125038
  derived and/or modified sequence opt3 from hemagglutinin__InfluenzaA__ADM95780

SEQ ID NO: 127889 - RNA, 1701 nt, Artificial Sequence; identical to SEQ ID NO: 125528
  derived and/or modified sequence opt3 from hemagglutinin__InfluenzaA__ADM95783

SEQ ID NO: 127890 - RNA, 1701 nt, Artificial Sequence; identical to SEQ ID NO: 124685
  derived and/or modified sequence opt3 from hemagglutinin__InfluenzaA__ADM95784

SEQ ID NO: 127891 - RNA, 1701 nt, Artificial Sequence; identical to SEQ ID NO: 124685
  derived and/or modified sequence opt3 from hemagglutinin__InfluenzaA__ADM95785

SEQ ID NO: 127892 - RNA, 1701 nt, Artificial Sequence
  derived and/or modified sequence opt3 from hemagglutinin__InfluenzaA__ADM95786
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugagcaggaaggaagaaugaauuacuauuggacccugguggagccaggugauaagauuacauucgaagccacuggcaaccuagucguucccagguacgcuuuugccauggagcggaacgcagggucgggaaucauaauuucugacaccccugugcaugauugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguacgaagucagcucaaaaacaaugcaaaggagaucggcaacggauguuuugaguucuaucacaagugcgauaauacauguauggaauccgugaaaaacggcacuuacgacuaucccaaguacagcgaagaggccaaacugaauagagaggaaauugauggggucaaacuugagucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 127893 - RNA, 1701 nt, Artificial Sequence; identical to SEQ ID NO: 125038
  derived and/or modified sequence opt3 from hemagglutinin__InfluenzaA__ADM95788

SEQ ID NO: 127894 - RNA, 1701 nt, Artificial Sequence; identical to SEQ ID NO: 125038
  derived and/or modified sequence opt3 from hemagglutinin__InfluenzaA__ADM95789

SEQ ID NO: 127895 - RNA, 1701 nt, Artificial Sequence
  derived and/or modified sequence opt3 from hemagglutinin__InfluenzaA__ADM95790
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuacgcaagucuuauauaaaugacaagggcaaagaaguacugguucuuuggggcauccaccaccccuccacgucagcugaucaacagagcuuguaccagaacgccgacgcguacguguucgucgggaccagucgauauucuaagaaauuuaagccugagauugcaauccguccaaaagugagagaucaggagggaaggaugaauuacuauuggacucugguggaacccggugacaagauuacauucgaggccacuggcaaccuagucguuccucgguacgcuuuugccauggaacgcaacgcaggguccggaaucauaauuagcgauaccccagugcaugacugcaauacaaccugucaaacgccgaaaggcgcuaucaacacuucgcuccccuuccagaauauucacccuaucacaaucgguaagugcccaaaguauguaaaaucuaccaagcugagacuugccacugggcugaggaacauucccuccauacagucacggggauuguuuggcgcgaucgccggcuucauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguuuacagcuguugguaaggaguucaaccaccuggaaaagcgcaucgaaaauuuaaacaaaaagguggaugacggguuccuggauaucuggacuuacaaugccgagcuccuuguccuguuggaaaacgagcgaacccuagacuaucaugauucuaaugugaaaaaccuguacgagaagguaagaagccagcucaaaaacaaugcaaaggaaauuggcaacggauguuuugaguucuaucacaagugcgacaauacauguauggaaucaguuaaaaacggcacuuacgauuauccuaaguacagugaggaagccaaacugaauagggaggagaucgacggggugaaacuugaauccacccggauuuaucaaauacuggcuaucuacagcacagucgcgucuucauuggugcucgucgugagucugggagcaauuagcuuuuggaugugcuccaacgguucuuuacagugccguaucuguaucuga

SEQ ID NO: 127896 - RNA, 1701 nt, Artificial Sequence; identical to SEQ ID NO: 127895
  derived and/or modified sequence opt3 from hemagglutinin__InfluenzaA__ADM95791

SEQ ID NO: 127897 - RNA, 1701 nt, Artificial Sequence; identical to SEQ ID NO: 127895
  derived and/or modified sequence opt3 from hemagglutinin__InfluenzaA__ADM95792

SEQ ID NO: 127898 - RNA, 1701 nt, Artificial Sequence; identical to SEQ ID NO: 127282
  derived and/or modified sequence opt3 from hemagglutinin__InfluenzaA__ADM95793

SEQ ID NO: 127899 - RNA, 1701 nt, Artificial Sequence; identical to SEQ ID NO: 125038
  derived and/or modified sequence opt3 from hemagglutinin__InfluenzaA__ADM95794

SEQ ID NO: 127900 - RNA, 1701 nt, Artificial Sequence; identical to SEQ ID NO: 124685
  derived and/or modified sequence opt3 from hemagglutinin__InfluenzaA__ADM95795

SEQ ID NO: 127901 - RNA, 1701 nt, Artificial Sequence; identical to SEQ ID NO: 125787
  derived and/or modified sequence opt3 from hemagglutinin__InfluenzaA__ADM95798

SEQ ID NO: 127902 - RNA, 1701 nt, Artificial Sequence
  derived and/or modified sequence opt3 from hemagglutinin__InfluenzaA__ADM95799
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggagaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucgagaacggcuguuuugaguucuaucacaagugcgacaauacauguauggagagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 127903 - RNA, 1701 nt, Artificial Sequence
  derived and/or modified sequence opt3 from hemagglutinin__InfluenzaA__ADM95800
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggcccccggugacaagauuacauucgaagcuacuggcaaccuagucguuccuagguacgccuuugcaauggagcggaacgcugggagcggaaucauaauuucggauaccccagugcaugacugcaauacaaccugucaaacgccgaaaggcgccaucaacacuucucuccccuuccagaauauucacccuaucacaaucgguaagugcccaaaguauguaaaauccaccaagcugcgccuugcgacugggcugagaaacgugcccucaauucagaguaggggauuguuuggcgccauagcaggcuucaucgaagggggauggacagguauggucgacggcugguacggguaucaucaccagaaugagcaaggaagcggcuacgcugccgaucucaaauccacccagaacgcuauugacgaaaucacgaauaaggugaacucuguuauagagaaaaugaauacccaguuuacagccguggguaaggaguucaaccaccuggaaaagcggauugagaauuuaaacaaaaaggucgaugacggguuccuggauaucuggacuuacaaugcagaacuccuugugcuguuggagaacgaacgcacccuagacuaucaugauagcaauguaaagaaccuguacgagaagguucgaucacagcucaaaaacaaugccaaggagaucggcaacggauguuuugaguucuaucacaagugcgacaauacauguauggagagugugaaaaacggcacuuacgauuauccuaaguacuccgaagaggcuaaacugaauagagaagagauugacggggucaaacuugagagcaccaggaucuaucaaauucuggcgauauacucuacaguggcaucaaguuugguccucgugguuagccugggagccaucuccuuuuggaugugcucuaacgguucguuacagugccggauuuguaucuga

SEQ ID NO: 127904 - RNA, 1701 nt, Artificial Sequence; identical to SEQ ID NO: 125038
  derived and/or modified sequence opt3 from hemagglutinin__InfluenzaA__ADM95801

SEQ ID NO: 127905 - RNA, 1701 nt, Artificial Sequence; identical to SEQ ID NO: 125038
  derived and/or modified sequence opt3 from hemagglutinin__InfluenzaA__ADM95802

SEQ ID NO: 127906 - RNA, 1701 nt, Artificial Sequence; identical to SEQ ID NO: 127892
  derived and/or modified sequence opt3 from hemagglutinin__InfluenzaA__ADM95803

SEQ ID NO: 127907 - RNA, 1701 nt, Artificial Sequence
  derived and/or modified sequence opt3 from hemagglutinin__InfluenzaA__ADM95804
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaauuuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaagguaaauuccguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacgugaaaaagcuguacgagaaaguucgaagccagcucaagaacaaugcaaaggaaaucggcaacggauguuuugaguucuaucacaaaugcgacaauacauguauggaaucagugaagaacggcacuuacgauuauccuaaauacagugaggaagccaagcugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 127908 - RNA, 1701 nt, Artificial Sequence; identical to SEQ ID NO: 126367
  derived and/or modified sequence opt3 from hemagglutinin__InfluenzaA__ADM95805

SEQ ID NO: 127909 - RNA, 1701 nt, Artificial Sequence; identical to SEQ ID NO: 125786
  derived and/or modified sequence opt3 from hemagglutinin__InfluenzaA__ADM95808

SEQ ID NO: 127910 - RNA, 1701 nt, Artificial Sequence; identical to SEQ ID NO: 125786
  derived and/or modified sequence opt3 from hemagglutinin__InfluenzaA__ADM95809

SEQ ID NO: 127911 - RNA, 1701 nt, Artificial Sequence; identical to SEQ ID NO: 125786
  derived and/or modified sequence opt3 from hemagglutinin__InfluenzaA__ADM95810

SEQ ID NO: 127912 - RNA, 1701 nt, Artificial Sequence
  derived and/or modified sequence opt3 from hemagglutinin__InfluenzaA__ADM95812
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcaggguccggaaucauaauuagcgauaccccagugcaugacugcaauacaaccugucaaacgccgaaaggcgcuaucaacacuucgcugcccuuccagaauauucacccuaucacaaucgguaagugcccaaaguauguaaaaucuaccaaacuucgccuggccacuggguugagaaacgugcccuccauucagucaaggggacucuuuggcgcgauagccggcuucaucgaagggggauggacagguauggucgacggcugguacggguaucaucaccagaaugaacaaggaaguggcuacgcagcugaucugaaaagcacccagaacgccauugacgagaucacgaauaaggugaacuccguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauucuaauguaaagaaccucuacgagaagguucgaagccagcugaaaaacaaugcaaaggaaaucggcaacggauguuuugaguucuaucacaagugcgacaauacauguauggaaucagugaaaaacggcacuuacgauuauccuaaguacagugaggaagccaaacuuaauagagaggagauugacggggucaagcuggaauccaccaggaucuaucaaauuuuggcuauauacagcacaguggcgucuucacucguccuggugguuaguuuaggagcaaucagcuuuuggaugugcuccaacgguucucugcagugccggauuuguaucuga

SEQ ID NO: 127913 - RNA, 1701 nt, Artificial Sequence; identical to SEQ ID NO: 127282
  derived and/or modified sequence opt3 from hemagglutinin__InfluenzaA__ADM95816

SEQ ID NO: 127914 - RNA, 1701 nt, Artificial Sequence; identical to SEQ ID NO: 127282
  derived and/or modified sequence opt3 from hemagglutinin__InfluenzaA__ADM95819

SEQ ID NO: 127915 - RNA, 1701 nt, Artificial Sequence; identical to SEQ ID NO: 126367
  derived and/or modified sequence opt3 from hemagglutinin__InfluenzaA__ADM95820

SEQ ID NO: 127916 - RNA, 1701 nt, Artificial Sequence; identical to SEQ ID NO: 127282
  derived and/or modified sequence opt3 from hemagglutinin__InfluenzaA__ADM95821

SEQ ID NO: 127917 - RNA, 1701 nt, Artificial Sequence; identical to SEQ ID NO: 125786
  derived and/or modified sequence opt3 from hemagglutinin__InfluenzaA__ADM95822

SEQ ID NO: 127918 - RNA, 1701 nt, Artificial Sequence; identical to SEQ ID NO: 125786
  derived and/or modified sequence opt3 from hemagglutinin__InfluenzaA__ADM95823

SEQ ID NO: 127919 - RNA, 1701 nt, Artificial Sequence
  derived and/or modified sequence opt3 from hemagglutinin__InfluenzaA__ADM95824
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgcauggccacugggcuuagaaacgugcccucaauucagaguaggggacuguuuggcgcgauagccggcuucaucgaagggggauggacagguauggucgacggcugguauggguaccaccaccagaaugaacaaggaagcggcuaugcagcugauuugaaauccacccagaacgccauugacgagaucacgaauaaggugaacucuguuauagagaaaaugaauacccaguuuacagcuguggguaaggaguucaaccaucucgaaaagcggauugaaaaucugaacaaaaaggucgaugacggguucuuagauaucuggacuuacaaugccgagcugcucgugcuucuggaaaacgagcgcaccuuggacuaccacgauagcaauguuaaaaaccuauaugagaagguacgaucacagcugaaaaacaaugcaaaggaaaucggcaacggauguuuugaguucuaccauaagugcgacaauacauguauggaaagugugaaaaacggcacuuaugauuacccuaaguauuccgaggaagccaaacucaauagagaggagauugacggggucaagcuggaaagcaccaggaucuaccaaauucuugcuauauauucuacaguggcgucaagucuggucuuggugguuagccucggagcaaucuccuuuuggaugugcucuaacgguucgcugcagugccggauuuguaucuga

SEQ ID NO: 127920 - RNA, 1701 nt, Artificial Sequence; identical to SEQ ID NO: 127282
  derived and/or modified sequence opt3 from hemagglutinin__InfluenzaA__ADM95825

SEQ ID NO: 127921 - RNA, 1701 nt, Artificial Sequence; identical to SEQ ID NO: 127282
  derived and/or modified sequence opt3 from hemagglutinin__InfluenzaA__ADM95826

SEQ ID NO: 127922 - RNA, 1701 nt, Artificial Sequence
  derived and/or modified sequence opt3 from hemagglutinin__InfluenzaA__ADM95827
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagagagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagcacgccauugacgagaucacgaacaaaguuaauucugugauagagaagaugaacacccaguuuacagcuguggguaaggaauuuaaucaucuggagaaaaggauugaaaacuuaaauaagaaagucgaugacggguuccuggauaucuggacuuacaacgccgagcuccuugugcuguuggaaaaugagcggacccuagacuaucacgauagcaacguaaagaaucuguacgagaaaguucgcucacagcucaagaacaacgcaaaggaaaucggcaauggauguuucgaguucuaucauaaaugcgacaacacauguauggaaagugugaagaauggcacuuacgauuauccuaaauacuccgaggaagccaagcugaaccgagaggagauugacggggucaaacuugaaagcaccagaaucuaucaaauucuggcuauauacucuacaguggcgucaaguuugguccucgugguuagccugggagcaaucuccuuuuggaugugcucuaaugguucguuacagugcaggauuuguaucuga

SEQ ID NO: 127923 - RNA, 1701 nt, Artificial Sequence
  derived and/or modified sequence opt3 from hemagglutinin__InfluenzaA__ADM95828
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagcucaugacugcaauacaaccugucaaacgccgaaaggcgccaucaacacuucucuccccuuccagaauauucacccuaucacaaucgguaagugcccaaaguaugugaaauccaccaagcugcgcauggcgacugggcuuagaaacguacccucaauucagaguaggggacuguuuggcgccauagcaggcuucaucgaagggggauggacagguaugguggacggcugguacggguaucaucaccagaaugaacaaggaagcggcuacgcugccgauuugaaauccacccagaacgcuauugacgagaucacgaauaaggucaacucugugauagagaaaaugaauacccaguuuacagccguugguaaggaguucaaccaccucgaaaagcggauugaaaaucugaacaaaaagguggaugacggguucuuagauaucuggacuuacaaugcagagcugcucguccuucuggaaaacgagcgcaccuuggacuaucaugauagcaaugugaaaaaccuauacgagaagguacgaucacagcugaaaaacaaugccaaggaaaucggcaacggauguuuugaguucuaucacaagugcgacaauacauguauggaaaguguuaaaaacggcacuuacgauuauccuaaguacuccgaggaagcuaaacucaauagagaggagauugacggggugaagcuggaaagcaccaggaucuaucaaauucuugcgauauacucuacagucgcaucaagucugguguuggucgugagccucggagccaucuccuuuuggaugugcucuaacgguucgcugcagugccggauuuguaucuga

SEQ ID NO: 127924 - RNA, 1701 nt, Artificial Sequence
  derived and/or modified sequence opt3 from hemagglutinin__InfluenzaA__ADM95829
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaagcuguacgagaaaguacgaucacagcucaagaacaacgcaaaggaaaucggcaauggauguuuugaguucuaucacaaaugcgacaacauguguauggaaagugugaagaauggcacauacgauuauccuaaauacuccgaggaagccaagcugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 127925 - RNA, 1701 nt, Artificial Sequence
  derived and/or modified sequence opt3 from hemagglutinin__InfluenzaA__ADM95831
augaaggccauccuggugguccuccuuuacaccuucguuacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaagaacucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagggcaaagaaguacuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggagaaaaacgccgggagcggaaucauaauuucggauaccccaguacaugacugcaauacaaccugucaaacgccgaagggcgcaaucaacacuucucuccccuuccagaauauucacccuaucacaaucgguaagugcccaaaauaugugaaguccaccaaacugcggcuugcuacugggcugcgcaacguccccucaauucagaguagaggauuguuuggcgccauagcgggcuucaucgaagggggauggacagguaugguggacggcugguacggguaucaucaccagaaugaacaaggaagcggcuacgccgcagaucucaaguccacccagcacgcuauugacgagaucacgaacaaaguuaauucugugauagagaagaugaacacccaguuuacagccgucgguaaggaguucaaucaucuggagaaaaggauugaaaacuuaaauaagaaaguggaugacggguuccuggauaucuggacuuacaacgcugagcuccuuguacuguuggaaaaugagcggacccuagacuaucacgauagcaacguuaagaaucuguacgagaaagugcgcucacagcucaagaacaacgccaaggaaaucggcaauggauguuuugaguucuaucauaaaugcgacaacacauguauggaaagugucaagaauggcacuuacgauuauccuaaauacuccgaggaagcaaagcugaaccgagaggagauugacggggugaaacuugaaagcaccagaaucuaucaaauucuggccauauacucuacagucgcuucaaguuuggugcucguugugagccugggagcgaucuccuuuuggaugugcucuaaugguucguuacagugcaggauuuguaucuga

SEQ ID NO: 127926 - RNA, 1701 nt, Artificial Sequence; identical to SEQ ID NO: 125786
  derived and/or modified sequence opt3 from hemagglutinin__InfluenzaA__ADM95832

SEQ ID NO: 127927 - RNA, 1701 nt, Artificial Sequence; identical to SEQ ID NO: 126367
  derived and/or modified sequence opt3 from hemagglutinin__InfluenzaA__ADM95833

SEQ ID NO: 127928 - RNA, 1701 nt, Artificial Sequence; identical to SEQ ID NO: 127912
  derived and/or modified sequence opt3 from hemagglutinin__InfluenzaA__ADM95834

SEQ ID NO: 127929 - RNA, 1701 nt, Artificial Sequence; identical to SEQ ID NO: 126367
  derived and/or modified sequence opt3 from hemagglutinin__InfluenzaA__ADM95836

SEQ ID NO: 127930 - RNA, 1701 nt, Artificial Sequence; identical to SEQ ID NO: 127282
  derived and/or modified sequence opt3 from hemagglutinin__InfluenzaA__ADM95837

SEQ ID NO: 127931 - RNA, 1701 nt, Artificial Sequence
  derived and/or modified sequence opt3 from hemagglutinin__InfluenzaA__ADM95838
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggacuucucgcuauuccaagaaauuuaagcccgagauugcaauccgaccuaaagugcgugaucaggagggaagaaugaauuacuauuggacccuaguggaaccaggugacaagauuacauucgaggccacuggcaaccucgucguucccagguacgcuuuugccauggaacggaacgcagggagcggaaucauaauuucggauaccccugugcaugacugcaauacaaccugucaaacgccaaaaggcgcuaucaacacuucucugccguuccagaauauucaccccaucacaaucgguaagugcccuaaguauguaaaauccaccaaacuucgccuggccacuggguugagaaacgugccaucaauucagaguaggggacucuuuggcgcgauagccggcuucaucgaagggggauggacagguauggucgacggcugguacggguaucaucaccagaaugaacaaggaagcggcuacgcagcugaucugaaguccacccagaacgccauugacaagaucacgaauaaagugaacucuguuauagagaagaugaauacccaguuuacagcuguggguaaggaguucaaccacuuagaaaaacggauugagaaucugaacaagaaagucgaugacggguuccucgauaucuggacuuacaaugccgaacuucugguguugcuagagaacgaacgcacccuggacuaucaugauagcaauguaaagaaccucuacgagaaaguucgaucacagcugaagaacaaugcaaaggagaucggcaacggauguuuugaguucuaucacaaaugcgacaauacauguauggaaagugugaagaacggcacuuacgauuaucccaaauacuccgaagaggccaaacuuaauagagaagagauugacggggucaagcuggagagcaccaggaucuaucaaauuuuggcuauauacucuacaguggcgucaagucucguccuggugguuagcuuaggagcaaucuccuuuuggaugugcucuaacgguucgcugcagugccggauuuguaucuga

SEQ ID NO: 127932 - RNA, 1701 nt, Artificial Sequence; identical to SEQ ID NO: 126367
  derived and/or modified sequence opt3 from hemagglutinin__InfluenzaA__ADM95839

SEQ ID NO: 127933 - RNA, 1701 nt, Artificial Sequence; identical to SEQ ID NO: 127892
  derived and/or modified sequence opt3 from hemagglutinin__InfluenzaA__ADM95840

SEQ ID NO: 127934 - RNA, 1701 nt, Artificial Sequence; identical to SEQ ID NO: 127892
  derived and/or modified sequence opt3 from hemagglutinin__InfluenzaA__ADM95842

SEQ ID NO: 127935 - RNA, 1701 nt, Artificial Sequence; identical to SEQ ID NO: 127282
  derived and/or modified sequence opt3 from hemagglutinin__InfluenzaA__ADM95843

SEQ ID NO: 127936 - RNA, 1701 nt, Artificial Sequence; identical to SEQ ID NO: 127282
  derived and/or modified sequence opt3 from hemagglutinin__InfluenzaA__ADM95844

SEQ ID NO: 127937 - RNA, 1701 nt, Artificial Sequence
  derived and/or modified sequence opt3 from hemagglutinin__InfluenzaA__ADM95845
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgcauggccacugggcuuagaaacgugcccucaauucagaguaggggacuguuuggcgcgauagccggcuucaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguuuacagcuguggguaaggaguucaaccaccucgaaaagcggauugaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaaaccaaacucaauagagaggagauugacggggucaagcuggaaagcacaaggaucuaucaaauucuugccauauacucuaccguggcuucaagucuggucuuggugguuagccucggagcgaucuccuuuuggaugugcucuaacgguucgcugcagugccggauuuguaucuga

SEQ ID NO: 127938 - RNA, 1701 nt, Artificial Sequence
  derived and/or modified sequence opt3 from hemagglutinin__InfluenzaA__ADM95846
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugaggccucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacauucccucaauacagaguaggggauuguuuggcgccaucgcaggcuucauugaagggggauggacugguaugguggacggcugguacggguaucaucaccagaaugaacaaggaagcggcuacgcugccgaucucaaauccacacagaacgcuaucgacgagauaaccaauaaggucaacucugugauugagaaaaugaauacgcaguuuaccgccguugguaaggaguucaaccaccuggaaaagcggaucgaaaauuuaaacaaaaagguggaugacggguuccuggauaucuggacauacaaugcagagcuccuuguccuguuggaaaacgagcgcacucuagacuaucaugauagcaaugugaaaaaccuguacgagaagguacgaucacagcucaaaaacaaugccaaggaaauuggcaacggauguuuugaguucuaucacaagugcgacaauaccuguauggaaaguguuaaaaacggcacauacgauuauccuaaguacuccgaggaagcuaaacugaauagagaggagaucgacggggugaaacuugaaagcacuaggauuuaucaaauacuggcgaucuacucuaccgucgcaucaaguuuggugcucgucgugagccugggagccauuuccuuuuggaugugcucuaacgguucguuacagugccggaucuguaucuga

SEQ ID NO: 127939 - RNA, 1701 nt, Artificial Sequence; identical to SEQ ID NO: 125786
  derived and/or modified sequence opt3 from hemagglutinin__InfluenzaA__ADM95847

SEQ ID NO: 127940 - RNA, 1701 nt, Artificial Sequence; identical to SEQ ID NO: 125786
  derived and/or modified sequence opt3 from hemagglutinin__InfluenzaA__ADM95848

SEQ ID NO: 127941 - RNA, 1701 nt, Artificial Sequence
  derived and/or modified sequence opt3 from hemagglutinin__InfluenzaA__ADM95849
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaagcuguacgagaaaguacgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugaucagccugggagcaauuuccuuuuggaugugcucuaaugguucguuacagugccggaucuguaucuga

SEQ ID NO: 127942 - RNA, 1701 nt, Artificial Sequence; identical to SEQ ID NO: 127282
  derived and/or modified sequence opt3 from hemagglutinin__InfluenzaA__ADM95850

SEQ ID NO: 127943 - RNA, 1701 nt, Artificial Sequence
  derived and/or modified sequence opt3 from hemagglutinin__InfluenzaA__ADM95851
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacauucccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 127944 - RNA, 1701 nt, Artificial Sequence
  derived and/or modified sequence opt3 from hemagglutinin__InfluenzaA__ADM95852
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaagcuguacgagaaaauccgaucacagcucaagaacaacgcaaaggaaauuggcaauggauguuuugaguucuaucacaaaugcgacaacacauguauggaaaguguaaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 127945 - RNA, 1701 nt, Artificial Sequence; identical to SEQ ID NO: 126105
  derived and/or modified sequence opt3 from hemagglutinin__InfluenzaA__ADM95854

SEQ ID NO: 127946 - RNA, 1701 nt, Artificial Sequence
  derived and/or modified sequence opt3 from hemagglutinin__InfluenzaA__ADM95855
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguuaaaaagcuguacgagaaaguacgaucacagcucaagaacaacgccaaggaaaucggcaauggauguuuugaguucuaucacaaaugcgacaacacuuguauggaaagugugaagaauggcaccuacgauuauccuaaauacuccgaggaagcaaagcugaacagagaggagauugacggggucaaacuugaaagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 127947 - RNA, 1701 nt, Artificial Sequence
  derived and/or modified sequence opt3 from hemagglutinin__InfluenzaA__ADM95857
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgcauggccacugggcuuagaaaugugcccuccauucagucaaggggacuguuuggcgcgauagccggcuucaucgaagggggauggacagguauggucgacggcugguacggguaucaucaccagaacgaacaaggaaguggcuacgcagcugauuugaaaagcacccagaaugccauugacgagaucacgaacaagguaaauuccguuauagagaaaaugaacacccaguuuacagcuguggguaaggaguucaaucaccucgaaaagcggauugaaaaccugaauaaaaaggucgaugacggguucuuagauaucuggacuuacaacgccgagcugcucgugcuucuggaaaaugagcgcaccuuggacuaucaugauucuaacgugaaaaaccuauacgagaagguucgaagccagcugaaaaauaacgcaaaggaaaucggcaauggauguuuugaguucuaucacaagugcgacaacacauguauggaaucagugaaaaauggcacuuacgauuauccuaaguacagugaggaagccaaacucaacagagaggagauugacggggucaagcuggaauccaccaggaucuaucaaauucuugcuauauacagcacaguggcgucuucacuggucuuggugguuagucucggagcaaucagcuuuuggaugugcuccaaugguucucugcagugccggauuuguaucuga

SEQ ID NO: 127948 - RNA, 1701 nt, Artificial Sequence; identical to SEQ ID NO: 126367
  derived and/or modified sequence opt3 from hemagglutinin__InfluenzaA__ADM95858

SEQ ID NO: 127949 - RNA, 1701 nt, Artificial Sequence
  derived and/or modified sequence opt3 from hemagglutinin__InfluenzaA__ADM95859
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaagaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaagcuguacgaaaaaguacgaucacagcucaagaacaacgcaaaggagaucgggaauggcuguuuugaguucuaucacaaaugcgacaacacauguauggaaagugugaagaauggaacuuacgauuauccuaaauacuccgaagaggccaagcugaacagagaggaaauugacggcgucaaacuugagagcaccaggaucuaucaaauucuggcuauauacucuacaguggcgucaaguuugguccucgugguuagccugggggcaaucuccuuuuggaugugcucuaauggaucguuacagugccggauuuguaucuga

SEQ ID NO: 127950 - RNA, 1701 nt, Artificial Sequence; identical to SEQ ID NO: 126312
  derived and/or modified sequence opt3 from hemagglutinin__InfluenzaA__ADM95860

SEQ ID NO: 127951 - RNA, 1701 nt, Artificial Sequence; identical to SEQ ID NO: 127912
  derived and/or modified sequence opt3 from hemagglutinin__InfluenzaA__ADM95862

SEQ ID NO: 127952 - RNA, 1701 nt, Artificial Sequence
  derived and/or modified sequence opt3 from hemagglutinin__InfluenzaA__ADM95864
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccacgugugagagaucaggagggaaggaugaauuaccauuggacccugguggaacccggugacaaaauuacauucgaggccacuggcaaccuagucguuccucgguaugcuuuugccauggaacgcaacgcagggagcggaaucauaauuucggauaccccagugcacgacugcaauacaaccugucaaacgccgaagggcgcuaucaacacuucucuccccuuccagaauauucauccuaucacaaucgguaaaugcccaaaguacguaaaguccaccaaacugagacuugccacugggcugaggaacauucccucaauacagagucggggauuguuuggcgcgaucgccggcuucauugaagggggauggacagguaugguggacggcugguauggguaccaccaccagaaugaacaaggaagcggcuaugcagcugaucucaaguccacccagaacgccaucgacgagauaacgaauaaagucaacucugugauugagaagaugaauacccaguuuacagcuguugguaaagaguucaaccaucuggaaaagcgcaucgaaaauuuaaacaagaaaguggaugacggguuccuggauaucuggacuuacaaugccgagcuccuuguccuguuggaaaacgagcgaacccuagacuaccacgauagcaaugugaagaaccuguaugagaaaguaagaucacagcucaagaacaaugcaaaagaaauuggcaacggauguuuugaguucuaccauaagugcgacaauacauguauggaaaguguuaagaacggcacuuaugauuacccuaaauauuccgaggaagccaagcugaauagggaggagaucgacggggugaaacuugaaagcacccggauuuaccaaauacuggcuaucuauucuacagucgcgucaaguuuggugcucgucgugagccugggagcaauuuccuuuuggaugugcucuaacgguucguuacagugccguaucuguaucuga

SEQ ID NO: 127953 - RNA, 1701 nt, Artificial Sequence; identical to SEQ ID NO: 126237
  derived and/or modified sequence opt3 from hemagglutinin__InfluenzaA__ADM95865

SEQ ID NO: 127954 - RNA, 1701 nt, Artificial Sequence
  derived and/or modified sequence opt3 from hemagglutinin__InfluenzaA__ADM95866
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagaucucuucgucagacaacggaacuugcuauccaggcgauuuuauugacuacgaggagcucagggagcagcugagcaguguguccucuuucgaacgguuugagaucuucccgaagacaagcuccuggcccaaucacgauucaaacaagggugucaccgcagccuguccucaugcuggggcaaaaaguuuuuauaagaaucugauauggcucgugaaaaagggaaacagcuacccaaaauuaucuaaguccuauaucaaugacaagggcaaagaaguacugguucuuuggggcauucaccaccccucaacgagcgccgaucaacagaguuuguaccagaacgcugacgccuacguguucgucgggacuucucgcuauuccaagaaauuuaagccugagaucgcgauucgaccaaaagugcgugaucaggagggaagaaugaauuacuauuggacccugguggaacccggugacaagaucacauucgaggcaacuggcaaccuagucguuccuagguacgccuuugcuauggaacggaacgccgggagcggaauaauuaucucggauaccccagugcaugacugcaauacaaccugucaaacgccgaaaggcgcaauuaacacuucucuccccuuccagaauauccacccuaucacaauugguaagugcccaaaguauguaaaauccaccaagcugcgccuugugacugggcugagaaacguccccucaauacagaguaggggauuguuuggcgcuaucgccggcuucauugaagggggauggacagguaugguggacggcugguacggguaucaucaccagaaugaacaaggaagcggcuacgcggccgaucucaaauccacccagaacgcaaucgacaagauaacgaauaaaguuaacucugugauugagaagaugaauacccaguuuacagcugucgguaaggaguucaaccaccuggaaaaacggaucgagaauuuaaacaagaaaguggaugacggguuccuggauaucuggacuuacaaugccgaacuccuuguacuguuggagaacgaacgcacccuagacuaucaugauagcaauguuaagaaccuguacgagaaagugcgaucacagcucaagaacaaugcuaaggagauuggcaacggauguuuugaguucuaucacaaaugcgacaauacauguauggaaagugucaagaacggcacuuacgauuauccuaaauacuccgaagaggccaagcugaauagagaagagaucgacggggugaaacuugagagcaccaggauuuaucaaauacuggcaaucuacucuacagccgcuucaaguuugguccucgugguuagccugggagcgauuuccuuuuggaugugcucuaacgguucguuacagugccggaucuguaucuga

SEQ ID NO: 127955 - RNA, 1698 nt, Artificial Sequence; identical to SEQ ID NO: 127529
  derived and/or modified sequence opt3 from hemagglutinin__InfluenzaA__ADN06300

SEQ ID NO: 127956 - RNA, 1698 nt, Artificial Sequence
  derived and/or modified sequence opt3 from hemagglutinin__InfluenzaA__ADN06311
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugucauccuuugaaagguucgagauuuuuccuaaggguaguuccuggccaaaccacacugucacaggggugucugccagcugcucccauaauggagagaacucauucuaucggaaucugcuuugguugaccggcaaaaacggccuguaccccaaucuaaguaagagcuaugcaaacaacaaagaaaaggagguacucguucuguggggagugcaccacccuccaaauaucgccgaccagaaaacgcuuuaccauacugaaaacgcuuacgucucugugguguccucacacuauagccgcaaguuuacccccgagauagcaaagcgaccuaaaguccgugaucaggaagggagaaucaauuacuauuggacacuguuggagccaggugacacuauuaucuucgaggccaacggcaaucucauugcuccgagguacgccuuugcgcugagucggggguucggaucuggcaucauaaacuccaaugcacccauggauaagugugacgccaaaugccagaccccucaaggugcuauuaacagcucguuaccauuucagaauguucaucccgugacaaucggggaauguccuaaguauguacgcucugccaaacugagaauggugaccggacucaggaacauuccauccauccagucacggggccuuuucggcgcaaucgcuggguuuauugagggagguuggacgggcauggucgaugggugguacggauaucaccaccagaaugaacaaggcagugguuacgccgcggaccaaaagagcacucagaacgccauaaaugggaucacaaacaaagugaauagcguuauugagaagaugaacacccaguucacugcagugggcaaggaauuuaacaaacuggagcgccgaauggagaauuugaacaagaaagucgaugacggauucaucgauauauggacauacaaugcugaacuacuggugcuccuggagaacgaaagaacccuugacuuccaugacucuaauguaaagaaccuguaugagaaaguuaagagccaguugaagaauaacgccaaagaaauuggcaaugggugcuuugaguucuaccacaaguguaacgaugagugcauggaaucagugaaaaauggaacguaugacuaccccaaguauagugaggaauccaaacucaacagggagaagaucgauggugucaagcuggagagcaugggcguguaccagaucuuagcuauuuauucuaccgucgccucaagucuggugcuacucguuagccugggggcaaucuccuuuuggaugugcucuaauggaucgcuucagugucggauuugcauauga

SEQ ID NO: 127957 - RNA, 1698 nt, Artificial Sequence
  derived and/or modified sequence opt3 from hemagglutinin__InfluenzaA__ADN06322
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacauggucgaccagcgcacgcuguaccgaacugagaaugccuacguguccguggucucaagccauuauagucguaaauucacccccgaaaucgcuaagagaccuaagguuagggaucaggaggggcggauaaacuacuauuggacacuucuggagccaggagacacuaucauuuuugaagcaaaugguaacuugaucgccccgcgcuacgcuuucgcccucucuagaggcuuuggguccggaauuaucaauagcaacgcgcccaugggcaaaugugaugcaaagugccagaccccucaaggugccauaaauucgucucugccauuccagaacgugcaccccguaacaauuggggaguguccuaaauaugugagguccgcuaaguuacggauggucaccggacugcgcaauaucccaucaauucagagucgaggccucuuuggcgccaucgcaggguucaucgaaggagguuggacgggcaugguggacgggugguacggauaucaucaccagaacgagcaaggcagcgguuacgcugccgaucagaaauccacucagaaugcgauuaacgggauaacaaauaagguuaacucugugaucgaaaagaugaauacccaguuuacugccgucggcaaggaguucaacaaacuugagagaaggauggaaaaccugaauaaaaagguggacgauggauucauugacaucuggacauacaacgcagaguugcuaguacugcucgaaaaugagcggacccuggauuuucacgacagcaacguuaaaaaucuuuaugaaaaggugaaaucacaacugaagaacaaugcuaaggagauaggcaacgggugcuucgaguuuuaccauaaauguaaugacgaaugcauggagagugucaagaacggaacguaugauuaccccaaauauuccgaagagagcaaguugaaucgugagaaaauugacggugugaagcucgaaucuaugggcgucuaccagauccuggccaucuauucaaccguggcuaguagcuuaguucugcuagugucccucggggccauuucuuucuggaugugcucgaacggaagccugcagugucgcaucugcauuuga

SEQ ID NO: 127958 - RNA, 1698 nt, Artificial Sequence
  derived and/or modified sequence opt3 from hemagglutinin__InfluenzaA__ADN06344
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccauccaucucagaccagaaaacgcuguaccauacugagaacgccuacgucagcguggugaguucucacuauucccgcaaguucacccccgaaauagcuaagcgaccuaaaguccgugaucaggaggggagaaucaauuacuauuggacacuucuggagccaggagacacuauuaucuuugaagcaaacgguaauuugauugccccgagguacgcuuucgcccucagccggggcuuugggucgggaaucauaaacucuaaugcgcccauggauaagugugacgcaaaaugccagaccccucaaggcgccauuaacuccucacugccauuccagaauguucaucccgugacaaucggugaguguccuaaguauguacgcagugcuaaauuaagaauggugaccgggcugaggaacauuccaagcauccagucccggggacucuuuggcgccaucgcaggcuucauugaagggggauggacggguauggucgauggcugguacggguaucaccaccagaaugagcaaggaucuggcuacgcugccgaccagaaaagcacucagaacgcgauaaaugguaucacaaacaaaguaaauucaguuauugaaaagaugaacacccaguuuacugccguggggaaggaguucaauaaacuugagcgccgaauggaaaaccugaacaagaaagucgaugacggcuucaucgauauauggacauacaaugcagaguugcuagugcugcucgaaaacgagagaacccuggacuuucaugacaguaauguaaagaaccuuuaugaaaaaguuaagucccaacugaagaauaacgcuaaagagauuggaaauggcugcuucgaguuuuaccacaaguguaacgaugaaugcauggagagcgugaaaaaugggacguaugacuaccccaaguauucugaagagucaaaauugaacagggagaagaucgauggagucaagcucgaaaguauggguguguaccagauccuggccauuuauagcaccgucgcuuccucuuuagugcugcuaguuucgcucggcgccaucagcuucuggaugugcuccaaugggucacugcagugucggauuugcauauga

SEQ ID NO: 127959 - RNA, 1701 nt, Artificial Sequence; identical to SEQ ID NO: 127549
  derived and/or modified sequence opt3 from hemagglutinin__InfluenzaA__ADN06366

SEQ ID NO: 127960 - RNA, 1701 nt, Artificial Sequence
  derived and/or modified sequence opt3 from hemagglutinin__InfluenzaA__ADN26165
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucauaaagaagggcaacagcuacccaaaauuaucuaaguccuauaucaaugauaagggcaaagaagugcugguacuuugggggauucaccaccccucaacgagcgcugaccaacagaguuuguaccagaacgccgaugcguacguuuucgugggaacuucucgcuauuccaagaaauuuaagccugagaucgcaauucgaccaaaaguccgugaccaggaggguagaaugaauuacuauuggacccugguggaacccggcgauaagaucacauucgaggccacugggaaccuaguggucccuagguacgcuuuugccauggaacggaacgcaggaagcggcauaauuaucucggacaccccaguucaugauugcaauacaaccugucaaacgccgaaaggugcuauuaacacuucucuccccuuccagaauauccacccuaucacaauugggaagugcccaaaguaugugaaauccaccaagcugcgccuugccacuggacugagaaacauacccucaauccagaguaggggcuuguuuggcgcgauugccggguucaucgagggagguuggacaggcaugguagacgggugguacggauaucaucaccagaaugaacaaggcagcgguuacgcagcugaccucaaauccacccagaacgccauagaugagauuacgaauaaggugaacucugucaucgagaaaaugaauacccaguuuacagcuguggggaaggaguucaaccaccuggagaagcggaucgaaaauuuaaacaaaaagguugacgauggcuuccuggacauuuggacuuacaaugccgagcuccuugugcuguuggaaaacgagcgcacccuagauuaucaugacagcaaugucaaaaaccuguacgagaaggugcgaucacagcucaaaaacaaugcaaaggaaaucggaaacggcuguuuugaguucuaucacaagugcgauaauacauguauggaaaguguuaaaaacgggacuuacgacuauccuaaguacuccgaggaagccaaacugaauagagaggagauugauggaguaaaacuugaaagcgcuaggauauaucaaauccuggcgauuuacucuaccguggcaucaaguuugguccucguggucagccugggugccaucuccuuuuggaugugcucuaacggcucguuacagugccggaucuguauuuga

SEQ ID NO: 127961 - RNA, 1701 nt, Artificial Sequence; identical to SEQ ID NO: 124865
  derived and/or modified sequence opt3 from hemagglutinin__InfluenzaA__ADN26175

SEQ ID NO: 127962 - RNA, 1701 nt, Artificial Sequence
  derived and/or modified sequence opt3 from hemagglutinin__InfluenzaA__ADN78194
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacgggcugcucgauaucuggaccuacaaugcugaacuucugguguugcuagagaacgaacgcacacuggacuaucaugauagcaauguaaagaaccucuacgagaaaguucgaucacagcugaagaacaaugccaaggagaucggcaacggauguuucgaauuuuaucacaaaugcgacaauacuuguauggagagugugaagaacggcaccuacgauuauccuaaauacuccgaagaggcaaaacuuaauagagaagagauugacggggucaagcuggagagcacaaggaucuaucaaauuuuggccauauacucuaccguggcuucaagucucguccuggugguuagcuuaggagcgaucuccuucuggaugugcucuaacgguucgcugcagugccggauuuguaucuga

SEQ ID NO: 127963 - RNA, 1701 nt, Artificial Sequence; identical to SEQ ID NO: 125849
  derived and/or modified sequence opt3 from hemagglutinin__InfluenzaA__ADN78195

SEQ ID NO: 127964 - RNA, 1701 nt, Artificial Sequence; identical to SEQ ID NO: 126237
  derived and/or modified sequence opt3 from hemagglutinin__InfluenzaA__ADN78212

SEQ ID NO: 127965 - RNA, 1701 nt, Artificial Sequence; identical to SEQ ID NO: 126237
  derived and/or modified sequence opt3 from hemagglutinin__InfluenzaA__ADN78221

SEQ ID NO: 127966 - RNA, 1698 nt, Artificial Sequence; identical to SEQ ID NO: 127956
  derived and/or modified sequence opt3 from hemagglutinin__InfluenzaA__ADN89050

SEQ ID NO: 127967 - RNA, 1698 nt, Artificial Sequence
  derived and/or modified sequence opt3 from hemagglutinin__InfluenzaA__ADN89061
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggaggugcuaguucucuggggcgugcaccacccuccauccaucucagaccagaaaacgcuguaccauacugaaaacgccuacgucagcguggugaguucucacuauucccgcaaguucacccccgagauagcuaagcgaccuaaaguccgugaucaggagggcagaaucaauuacuauuggacacuucuggaaccaggggacacuauuaucuuugaggcaaacggaaauuugauugccccgagguacgcuuucgcccucagccgggguuuuggcucggggaucauaaacucuaaugcgcccauggauaagugugacgcaaaaugccagaccccucaaggagccauuaacuccucacugccauuccagaauguucaucccgugacaaucggcgaauguccuaaguauguacgcagugcuaaauuaagaauggugaccggucugaggaacauuccaagcauccagucccgggggcucuuuggagccaucgcaggcuucauugagggcggguggacgggaauggucgaugguugguacggcuaucaccaccagaaugaacaagggucuggauacgcugccgaccagaagucaacucagaacgcgauaaaugagaucacaaacaaaguaaauucaguuauugagaagaugaacacccaguuuacugccgugggcaaggaguucaauaaacuugaacgccgaauggaaaaccugaacaagaaagucgaugacgguuucaucgauauauggacauacaaugcagaguugcuagugcugcucgaaaacgagagaacccuggacuuucaugacaguaauguaaagaaccuuuaugagaaaguuaagaaucaacugaagaacaaugcuaaagaaauugggaacggcugcuucgaguuuuaccacaaguguaaugaugaaugcauggaguccgugaaaaacggaacguaugacuaccccaaguauagcgaggaaucuaaauugaauagggagaagaucgauggcgucaagcucgaaucaauggggguguaccagauccuggccauuuauaguaccgucgcuagcuccuuagugcugcuaguuucucucggagccaucucguucuggaugugcagcaacgguucccugcagugucggauuugcauauga

SEQ ID NO: 127968 - RNA, 1698 nt, Artificial Sequence; identical to SEQ ID NO: 127958
  derived and/or modified sequence opt3 from hemagglutinin__InfluenzaA__ADN89072

SEQ ID NO: 127969 - RNA, 1698 nt, Artificial Sequence
  derived and/or modified sequence opt3 from hemagglutinin__InfluenzaA__ADN89083
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauauggccgaccagaaaacgcuguaccauacugagaacgcuuacgucucugugguguccucacacuauagccgcaaguucacccccgaaaucgcaaagcgaccuaaaguccgugaucaggaggggagaauaaauuacuauuggacacuucuggagccaggagacacuaucauuuuugaagccaacgguaauuugaucgcuccgagguacgccuucgcgcucagucggggcuuugggucuggaauuaucaacuccaaugcacccauggauaagugugacgccaaaugccagaccccucaaggcgcuauaaacagcucgcugccauuccagaauguucaucccgugacaauuggugaguguccuaaguauguacgcucugccaaauuaagaauggugaccgggcugaggaacaucccauccauucagucacggggacucuuuggcgcaaucgcuggcuucaucgaagggggauggacggguauggucgauggcugguacggguaucaccaccagaaugagcaaggaaguggcuacgccgcggaccagaaaagcacucagaacgccauuaaugguauaacaaacaaaguaaauuccguuaucgaaaagaugaacacccaguuuacugcaguggggaaggaguucaacaaacuugagcgccgaauggaaaaucugaacaagaaagucgaugacggcuucauugauaucuggacauacaaugcugaguugcuagugcugcucgaaaacgagagaacccuggacuuucaugacucuaauguaaagaaccuuuaugaaaaaguuaagagccaacugaagaauaacgccaaagagauaggaaauggcugcuucgaguuuuaccacaaguguaacgaugaaugcauggagucagugaaaaaugggacguaugacuaccccaaguauagugaagaguccaaauugaacagggagaagauugauggagucaagcucgaaagcauggguguguaccagauccuggcuaucuauucuaccgucgccucaaguuuagugcugcuaguuagccucggcgcaauuuccuucuggaugugcucuaaugggucgcugcagugucggaucugcauuuga

SEQ ID NO: 127970 - RNA, 1698 nt, Artificial Sequence
  derived and/or modified sequence opt3 from hemagglutinin__InfluenzaA__ADN89094
augaaggugaaacugcucguccuucugugcaccuucacagccacuuacgcugacacgaucuguauuggcuaucacgcaaacaauagcaccgauacaguugacacugccuuggagaagaacgugaccguaacacauuccgugaauuuacuggaaaacucucacaaugggaaacuaugccuccugaagggaauagcgccccuucagcuggguaacuguucagucgcuggcuggaucuuggggaauccugagugcgaacuccugauuaguaaagagagcugguccuacaucguggaaaagccaaacccggagaauggaaccuguuaucccggccauuuugccgauuacgaggaacugagagagcaacucucuucgguuagcagcuucgaaagguuugagauuuucccuaaggagaguuccuggccaaaccacacugugacaggugucucugcaagcugcucccauaauggggaaaacucauuuuaucggaauuuacuguggcuuaccgggaaaaacggcuuguaccccaaucugaguaagagcuaugccaacaacaaaggcaaggaggugcuaguacucuggggaguucaccacccuccaaauaucgcugaccagaaaacgcuguaccauacugaaaacgcauacgugucugucguguccucacacuauagccgcaaguucacccccgagauagccaagcgaccuaaagugcgugaucaggaaggaagaaucaauuacuauuggacacuucuggagccaggugacacuauuaucuuugaggcuaacggcaauuugauugccccgagguacgcguucgcacucagucggggguuuggaucuggcaucauaaacuccaaugcccccauggauaagugugacgcuaaaugccagaccccucaaggugccauuaacagcucgcugccauuccagaauguccaucccguuacaaucggggaauguccuaaguaugugcgcucugcaaaauuaagaaugguaaccggacugaggaacauuccauccauccagucacggggccucuuuggcgcuaucgccggguucauugagggagguuggacgggcaugguggaugggugguacggauaucaccaccagaaugaacaaggcagugguuacgcggccgaccagaagucaacucagaacgcaauaaaugggaucacaaacaaagucaauuccgugauugagaagaugaacacccaguuuacugcuguuggcaaggaguucaacaaacuugaacgccgaauggagaaucugaacaagaaaguggaugacggauucaucgauauauggacauacaaugccgaauugcuaguccugcucgagaacgaaagaacccuggacuuucaugacucuaaugugaagaaccuuuaugagaaaguaaagagccaacugaagaauaacgcuaaagaaauuggcaaugggugcuucgaguuuuaccacaaguguaacgaugagugcauggaaucaguuaaaaauggaacguaugacuaccccaaguauagugaggaauccaaauugaacagggagaagaucgauggugugaagcucgagagcaugggcgucuaccagauccuggccauuuauucuaccguggcaucaaguuuaguccugcuagugagccucggggccaucuccuucuggaugugcucuaauggaucgcugcagugucggauuugcauauga

SEQ ID NO: 127971 - RNA, 1698 nt, Artificial Sequence
  derived and/or modified sequence opt3 from hemagglutinin__InfluenzaA__ADN89116
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaaaacucucacaaugggaaacuaugccuccugaagggaaucgcgccccuucagcuggguaacuguucagucgccggcuggauuuuggggaauccugagugcgaacuccugaucaguaaagagagcugguccuacauuguggaaaagccaaacccggagaauggaaccuguuaucccggccauuuugcugauuacgaggaacugagagagcaacucucuucgguuagcucauucgaaagguuugagaucuucccuaaggagaguuccuggccaaaccacacugugacaggugucucugccagcugcucccauaauggggaaucaaguuuuuaucggaacuuacuguggcuuaccgugaaaaauggauuguaccccaaccugagcaagucuuaugcaaauaacaaagagaaggaaguucuaguacucuggggcgugcaccacccuccaaacauagucgaccagaaaacgcuguaccgcacugagaaugccuacguguccguggucucaagccauuauagucgaaaguucacccccgaaaucgcuaagcguccuaaaguuagagaucaggagggcaggauuaacuacuauuggacacuucuggagccaggggacacuaucauuuuugaagcaaauggaaacuugaucgccccgcgguacgcuuucgcccucucucgcgguuuuggcuccgggauaauuaauagcaacgcgcccauggauaagugugacgcaaaaugccagaccccuagaggagccaucaauucgucucugccauuccaaaacgugcaccccguaacaauuggcgaguguccuaaguaugugagguccgcuaaauuacggauggucaccggucugcgcaauaucccaucaauccagagucgagggcucuuuggagccauugcaggcuucauagaaggcggguggacgggaaugguggaugguugguacggcuaucaucaccagaacgagcaggggagcggauacgcugccgaccaaaaguccacucagaaugcgaucaacggcauuacaaauaaaguuaacucugugaucgaaaagaugaauacccaguuuacugccgucgguaaggaguucaacaaccuugagagaaggauggaaaaucugaacaaaaagguggaugacggguucauagauauuuggacauacaaugcagaguugcuaguacugcucgaaaacgagcggacccuggacuuucacgacagcaauguuaaaaaccuuuaugaaaaggugaaaucacagcugaagaauaacgcuaaggagaucggcaauggaugcuucgaguuuuaccauaaauguaacgaugaaugcauggagagugucaagaauggcacguaugacuaccccaaauauuccgaagagagcaaguugaaccgugagaaaaucgauggggugaagcucgaaucuaugggagucuaccaaauucuggccaucuauucaaccguggcuaguagcuuaguucugcuagugucccucggugccauuucuuucuggaugugcucgaauggcagccugcagugucgcauaugcaucuga

SEQ ID NO: 127972 - RNA, 1698 nt, Artificial Sequence
  derived and/or modified sequence opt3 from hemagglutinin__InfluenzaA__ADN89127
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugucauccuuugaaagguucgagauuuuuccuaaggguaguuccuggccaaaccacacugucacaggggugucugccagcugcucccauaauggagagaacucauucuaucggaaucugcuuugguugaccggcaaaaacggccuguaccccaaucuaaguaagagcuaugcaaacaacaaagaaaaggagguacucguucuguggggagugcaccacccuccaaauaucgccgaccagaaaacgcuuuaccauacugaaaacgcuuacgucucugugguguccucacacuauagccgcaaguuuacccccgagauagcaaagcgaccuaaaguccgugaucaggaagggagaaucaauuacuauuggacacuguuggagccaggugacacuauuaucuucgaggccaacggcaaucucauugcuccgagguacgccuuugcgcugagucggggguucggaucuggcaucauaaacuccaaugcacccauggauaagugugacgccaaaugccagaccccucaaggugcuauuaacagcucguuaccauuucagaauguucaucccgugacaaucggggaauguccuaaguauguacgcucugccaaacugagaauggugaccggacucaggaacauuccauccauccagucacggggccuuuucggcgcaaucgcuggguuuauugagggagguuggacgggcauggucgaugggugguacggauaucaccaccagaaugaacaaggcagugguuacgccgcggaccaaaagagcacucagaacgccauaaaugggaucacaaacaaagugaauagcguuauugagaagaugaacacccaguucacugcagugggcaaggaauuuaacaaacuggagcgccgaauggagaauuugaacaagaaagucgaugacggauucaucgauauauggacauacaaugcugaacuacuggugcuccuggagaacgaaagaacccuugacuuccaugacucuaauguaaagaaccuguaugagaaaguuaagagccaguugaagaauaacgccgaagagauuggcaaugggugcuuugaguucuaccacaaauguaacgaugaaugcauggagucagugaagaauggaacguaugacuaccccaaauauagugaagaguccaagcucaacagggagaaaaucgauggugucaagcuggaaagcaugggcguguaccagaucuuagcuauuuauucuaccgucgccucaagucuggugcuacucguuagccugggggcaaucuccuuuuggaugugcucuaauggaucgcuucagugucggauuugcauauga

SEQ ID NO: 127973 - RNA, 1698 nt, Artificial Sequence
  derived and/or modified sequence opt3 from hemagglutinin__InfluenzaA__ADN89149
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggagguucuaguacucuggggcgugcaccacccuccauccaucucagaccagaaaacgcuguaccauacugaaaacgccuacgucagcguggugaguucucacuauucccgcaaguucacccccgaggucgcuaagcgaccuaaaguucgugaucaggagggcagaauaaauuacuauuggacacuucuggaaccaggggacacuaucauuuuugaggcaaacggaaauuugaucgccccgagguacgcuuucgcccucagccgggguuuuggcucggggauuaucaacucuaaugcgcccauggauaagugugacgcaaaaugccagaccccucaaggagccauaaacuccucacugccauuccagaaugugcaucccguaacaauuggcgaauguccuaaguaugugcgcagugcuaaauuaagaauggucaccggucugaggaacaucccaagcauucagucccgggggcucuuuggagccaucgcaggcuucaucgagggcggguggacgggaaugguggaugguugguacggcuaucaccaccagaaugaacaagggucuggauacgcugccgaccagaagucaacucagaacgcgauuaauggcauaacaaacaaaguuaauucagugaucgagaagaugaacacccaguuuacugccgucgguaaggaguucaauaaacuugaacgccgaauggagaaccugaacaagaaaguggaugacggguucauugauaucuggacauacaaugcagaauugcuaguacugcucgagaacgaaagaacccuggacuuucaugacaguaauguuaagaaccuuuaugagaaagugaagucccaacugaagaauaacgcuaaagagauaggcaauggaugcuucgaauuuuaccacaaguguaacgaugagugcauggaaagcgucaaaaauggcacguaugacuaccccaaguauucugaggagucaaaauugaacagggaaaagauugauggggugaagcucgagaguaugggagucuaccagauccuggccaucuauagcaccguggcuuccucuuuaguucugcuagugucgcucggugccauuagcuucuggaugugcuccaauggcucacugcagugucggaucugcauuuga

SEQ ID NO: 127974 - RNA, 1698 nt, Artificial Sequence; identical to SEQ ID NO: 127529
  derived and/or modified sequence opt3 from hemagglutinin__InfluenzaA__ADN89171

SEQ ID NO: 127975 - RNA, 1698 nt, Artificial Sequence
  derived and/or modified sequence opt3 from hemagglutinin__InfluenzaA__ADN89182
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugagcucauuugaaagguucgagauuuuuccuaaggagaguuccuggccaaaccacacugucacaggugugucugccagcugcucccauaauggggaaucaaguuucuaucggaaccugcuuugguugaccggcaaaaauggacuguaccccaaccuaagcaagucuuaugcaaauaacaaagagaaggaaguacucguucuguggggcgugcaccacccuccaaacaucgucgaccagaaaacgcuuuaccgcacugagaaugccuacguguccguggucucaagccauuauagucgaaaguuuacccccgaaauagcuaagcguccuaaaguuagagaucaggaggggaggaucaacuacuauuggacacuguuggagccaggagacacuauuaucuucgaagcaaaugguaaccucauugccccgcgguacgcuuuugcccugucucgcggcuucggguccggaaucauaaauagcaacgcgcccauggauaagugugacgcaaaaugccagaccccucaaggcgccauuaauucgucuuuaccauuucagaacgugcaccccguaacaaucggugaguguccuaaguaugugagauccgcuaaacugaggauggucaccgggcuccggaauauuccaucaauccagagucgcggacuuuucggcgccaucgcaggcuuuauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguucacugccgucgggaaggaguuuaacaaacuggagcgaagaauggaaaacuugaauaagaaaguggaugacggcuucaucgauauauggacauacaacgcagagcuacugguacuccuggaaaaugagaggacccuugacuuccacgacagcaacguuaagaaucuguaugaaaaagugaagucacaauugaagaacaaugcuaaagagauuggaaacggcugcuuugaguucuaccauaaguguaaugaugaaugcauggagagugucaaaaacgggacguaugacuaccccaaguauuccgaagagagcaaacucaaucgggagaagaucgauggagugaagcuggaaucuaugggugucuaccagaucuuagccauuuauucaaccguggcuaguagccugguucuacucgugucccugggcgccaucucuuuuuggaugugcucgaacgggagccuucagugucguauuugcauauga

SEQ ID NO: 127976 - RNA, 1698 nt, Artificial Sequence; identical to SEQ ID NO: 127529
  derived and/or modified sequence opt3 from hemagglutinin__InfluenzaA__ADN89193

SEQ ID NO: 127977 - RNA, 1698 nt, Artificial Sequence; identical to SEQ ID NO: 127529
  derived and/or modified sequence opt3 from hemagglutinin__InfluenzaA__ADN89204

SEQ ID NO: 127978 - RNA, 1698 nt, Artificial Sequence; identical to SEQ ID NO: 127956
  derived and/or modified sequence opt3 from hemagglutinin__InfluenzaA__ADN89215

SEQ ID NO: 127979 - RNA, 1698 nt, Artificial Sequence
  derived and/or modified sequence opt3 from hemagglutinin__InfluenzaA__ADN89226
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacagagaaaaauggauuguaccccaaccugagcaagucuuaugccaauaacaaagaaaaggagguucuaguacucuggggcgugcaccacccuccauccaucucagaccagaaaacccuguaccauacggaaaacgcuuacgucagcguggugaguucucacuauucccgcaaguucacucccgagauagcaaagcgaccuaaaguccgugaucaggagggcagaaucaauuacuauuggacccuucuggaaccaggggacacaauuaucuuugaggccaacggaaauuugauugcuccgagguacgccuucgcgcucaaccgggguuuuggcagcgggaucauaaauucgaacgcacccauggauaagugugacgccaaaugccagacuccucaaggagcuauuaauucuucccugccauuccagaacguucaucccgugaccaucggcgaauguccuaaguauguacgcucagccaaauuaagaauggugacaggucugaggaauauuccaaguguccagagccgggggcucuuuggagcaaucgcuggcuucaucgagggcggguggaccggaaugguggaugguugguacggcuaucaccaccagaacgaacaaggguccggauacgccgcggaccagaagucuacgcagaaugccauuaacggcauaacuaauaaaguuaacagcgugaucgagaagaugaauacacaguuuaccgcagucgguaaggaguucaacaaacuugaacgccgaauggagaaccugaauaagaaaguggaugacggguucauugauaucuggacuuacaacgcugaauugcuaguacugcucgagaaugaaagaacacuggacuuucaugacucaaacguuaagaaucuuuaugagaaagugaagaaccaacugaagaauaacgccaaagagauaggcaauggaugcuucgaauuuuaccacaaguguaacgaugagugcauggaaagugucaaaaauggcaccuaugacuaccccaaguauuccgaggagagcaaauugaacagggaaaagauugauggggugaagcucgagucuaugggagucuaccagauccuggcuaucuauucaacgguggccaguagcuuaguucugcuagugucccucggugcaauuucuuucuggaugugcucgaauggcagccugcagugucggaucugcauuuga

SEQ ID NO: 127980 - RNA, 1698 nt, Artificial Sequence; identical to SEQ ID NO: 127956
  derived and/or modified sequence opt3 from hemagglutinin__InfluenzaA__ADN89237

SEQ ID NO: 127981 - RNA, 1698 nt, Artificial Sequence
  derived and/or modified sequence opt3 from hemagglutinin__InfluenzaA__ADN89248
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaaucgccggcuggauuuuggggaauccugagugcgaacuccugaucaguaaagagagcugguccuacauuguggaaaagccaaacccggagaauggaaccuguuaucccggccauuuugcugauuacgaggaacugagagagcaacucucuucgguuagcucauucgaaagguuugagaucuucccuaaggagaguuccuggccaaaccacacugugacaggugucucugccagcugcucccauaauggggaaucaaguuuuuaucggaacuuacuguggcuuaccggaaagaauggcuuguaccccaaccugagcaagucuuaugcaaauaacaaagagaaggaagugcuaguacucuggggcguucaccacccuccauccauaucagaccagaaaacgcuguaccauacugagaacgccuacgugagcgucgugaguucucacuauucccgcaaguucacccccgaaaucgcuaagcgaccuaaagugcgugaucaggaggggagaauuaauuacuauuggacacuucuggagccaggagacacuaucauuuuugaagcaaacgguaauuugaucgccccgagguacgcuuucgcccucagccggggcuuugggucgggaauaauuaacucuaaugcgcccauggauaagugugacgcaaaaugccagaccccucaaggcgccaucaacuccucacugccauuccagaauguccaucccguuacaauuggugaguguccuaaguaugugcgcagugcuaaauuaagaaugguaaccgggcugaggaacaucccaagcauccagucccggggacucuuuggcgccauugcaggcuucauagaagggggauggacggguaugguggauggcugguacggguaucaccaccagaaugagcaaggaucuggcuacgcugccgaccagaaaagcacucagaacgcgaucaaugguauuacaaacaaagucaauucagugaucgaaaagaugaacacccaguuuacugccguugggaaggaguucaauaaacuugagcgccgaauggaaaaccugaacaagaaaguggaugacggcuucauagauauuuggacauacaaugcagaguugcuaguccugcucgaaaacgagagaacccuggacuuucaugacaguaaugugaagaaccuuuaugaaaaaguaaagucccaacugaagaauaacgcuaaagagaucggaaauggcugcuucgaguuuuaccacaaguguaacgaugaaugcauggagagcguuaaaaaugggacguaugacuaccccaaguauucugaagagucaaaauugaacagggagaagaucgauggagugaagcucgaaaguaugggugucuaccagauucuggccaucuauagcaccguggcuuccucuuuaguccugcuagugucgcucggcgccauuagcuucuggaugugcuccaaugggucacugcagugucggauaugcaucuga

SEQ ID NO: 127982 - RNA, 1698 nt, Artificial Sequence; identical to SEQ ID NO: 127969
  derived and/or modified sequence opt3 from hemagglutinin__InfluenzaA__ADN89259

SEQ ID NO: 127983 - RNA, 1698 nt, Artificial Sequence
  derived and/or modified sequence opt3 from hemagglutinin__InfluenzaA__ADN89281
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggaggugcuaguucucuggggcgugcaccacccuccauccaucucagaccagaaaacgcuguaccauacugaaaacgccuacgucagcguggugaguucucacuauucccgcaaguucacccccgagauagcuaagcgaccuaaaguccgugaucaggagggcagaaucaauuacuauuggacacuucuggaaccaggggacacuauuaucuuugaggcaaacggaaauuugauugccccgagguacgcuuucgcccucagccgggguuuuggcucggggaucauaaacucuaaugcgcccauggauaagugugacgcaaaaugccagaccccucaaggagccauuaacuccucacugccauuccagaauguucaucccgugacaaucggcgaauguccuaaguauguacgcagugcuaaauuaagaauggugaccggucugaggaacauuccaagcauccagucccgggggcucuuuggagccaucgcaggcuucauugagggcggguggacgggaauggucgaugguugguacggcuaucaccaccagaaugaacaagggucuggauacgcugccgaccagaagucaacucagaacgcgauaaauggcaucacaaacaaaguaaauucaguuauugagaagaugaacacccaguuuacugccguggguaaggaguucaauaaacuugaacgccgaauggagaaccugaacaagaaagucgaugacggguucaucgauauauggacauacaaugcagaauugcuagugcugcucgagaacgaaagaacccuggacuuucaugacaguaauguaaagaaccuuuaugagaaaguuaagaaucaacugaagaacaaugcuaaagagauuggcaacggaugcuucgaauuuuaccacaaguguaaugaugagugcauggaauccgugaaaaacggcacguaugacuaccccaaguauagcgaggagucuaaauugaauagggaaaagaucgauggggucaagcucgagucaaugggaguguaccagauccuggccauuuauaguaccgucgcuagcuccuuagugcugcuaguuucucucggugccaucucguucuggaugugcagcaacggcucccugcagugucggauuugcauauga

SEQ ID NO: 127984 - RNA, 1698 nt, Artificial Sequence; identical to SEQ ID NO: 127983
  derived and/or modified sequence opt3 from hemagglutinin__InfluenzaA__ADN89292

SEQ ID NO: 127985 - RNA, 1698 nt, Artificial Sequence; identical to SEQ ID NO: 127983
  derived and/or modified sequence opt3 from hemagglutinin__InfluenzaA__ADN89303

SEQ ID NO: 127986 - RNA, 1698 nt, Artificial Sequence; identical to SEQ ID NO: 125642
  derived and/or modified sequence opt3 from hemagglutinin__InfluenzaA__ADN89314

SEQ ID NO: 127987 - RNA, 1698 nt, Artificial Sequence; identical to SEQ ID NO: 125147
  derived and/or modified sequence opt3 from hemagglutinin__InfluenzaA__ADN89325

SEQ ID NO: 127988 - RNA, 1698 nt, Artificial Sequence
  derived and/or modified sequence opt3 from hemagglutinin__InfluenzaA__ADN89336
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaagugcuaguucucuggggcgugcaccacccuccagacaucggggaucagaaaacgcuguaccauacugagaacgccuacgucucugugguguccucacacuauagccgaaaguucacccccgaaauagcuaagcguccuaaagucagagaccaggagggaaggaucaauuacuauuggacacuucuggagccaggugauacuauuaucuuugaagcaaacggcaauuugauugccccgcgguacgcuuucgcccucagucgcggguuuggaucuggcaucauaaacuccaaugcgcccauggacaagugugaugcaaaaugccagaccccucaaggugccauuaacagcucgcugccauuccagaauguucaucccgugacaaucggggaguguccuaaguauguaagaucugcuaaauuaaggauggugaccggacugcggaacauuccauccauccagucacgcggccucuuuggcgccaucgcaggguucauugaaggagguuggacgggcauggucgacgggugguacggauaucaccaccagaaugagcaaggcagugguuacgcugccgaucagaaaagcacucagaacgcgauaaaugggaucacaaacaaaguaaauuccguuauugaaaagaugaacacccaguuuacugccgugggcaaggaguucaauaaacuugagcgaagaauggaaaaccugaacaagaaagucgacgauggauucaucgacauauggacauacaaugcagaguugcuagugcugcucgaaaacgagaggacccuggacuuucaugauucuaauguaaagaaccuuuaugaaaaaguuaagagccaacugaagaauaacgcuaaagagauuggcaaugggugcuucgaguuuuaccacaaguguaacgacgaaugcauggagucagugaaaaauggaacguaugauuaccccaaguauagugaagaguccaaauugaaccgggagaagaucgacggugucaagcucgaaagcaugggcguguaccagauccuggccauuuauucuaccgucgcuucaaguuuagugcugcuaguuagccucggggccaucuccuucuggaugugcucuaauggaucgcugcagugucguauuugcauauga

SEQ ID NO: 127989 - RNA, 1698 nt, Artificial Sequence; identical to SEQ ID NO: 127979
  derived and/or modified sequence opt3 from hemagglutinin__InfluenzaA__ADN89347

SEQ ID NO: 127990 - RNA, 1698 nt, Artificial Sequence; identical to SEQ ID NO: 125147
  derived and/or modified sequence opt3 from hemagglutinin__InfluenzaA__ADN89358

SEQ ID NO: 127991 - RNA, 1698 nt, Artificial Sequence
  derived and/or modified sequence opt3 from hemagglutinin__InfluenzaA__ADN89369
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucauacccgaaaucgcuaagcguccuaaagugagagaucaggagggcaggauuaacuacuauuggacccuucuggagccaggggacacaaucauuuuugaagcaaauggaaacuugaucgccccgcgguacgcuuucgcccucucucgcgguuuuggcuccgggauaauuaauagcaacgcgcccauggauaagugugacgcaaaaugccagacuccuagaggagccaucaauucgucucugccauuccaaaacguacaccccgugaccauuggcgaguguccuaaguaugucagguccgcuaaauuacggauggugacaggucugcgcaauaucccaucaauccagagucgagggcucuuuggagccauugcaggcuucauagaaggcggguggaccggaaugguugaugguugguacggcuaucaucaccagaacgagcaggggagcggauacgcugccgaccaaaaguccacgcagaaugcgaucaacggcauuacuaauaaagugaacucugucaucgaaaagaugaauacacaguuuaccgccguggguaaggaguucaacaaacuugagagaaggauggaaaaccugaauaagaaaguagaugacggguucauagauauuuggacuuacaacgcagaguugcuaguucugcucgaaaaugagcggacacuggacuuucacgacagcaacgugaagaaucuuuaugaaaaagucaagucacagcugaagaacaaugcuaaagagaucggcaacggaugcuucgaguuuuaccauaaguguaaugaugaaugcauggagagugugaaaaacggcaccuaugacuaccccaaguauuccgaagagagcaaauugaaucgugagaagaucgauggggucaagcucgaaucuaugggaguguaccaaauucuggccaucuauucaacgguugcuaguagcuuagugcugcuaguaucccucggugccauuucuuucuggaugugcucgaacggcagccugcagugucgcauaugcaucuga

SEQ ID NO: 127992 - RNA, 1698 nt, Artificial Sequence
  derived and/or modified sequence opt3 from hemagglutinin__InfluenzaA__ADN89380
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugagcucauuugaaagguucgagauuuuuccuaaggagaguuccuggccaaaccacacugucacaggugugucugccagcugcucccauaauggggaaucaaguuucuaucggaaccugcuuugguugaccggcaaaaauggacuguaccccaaccuaagcaagucuuaugcaaauaacaaagagaaggaaguacucguucuguggggcgugcaccacccuccaaacaucgucgaccagaaaacgcuuuaccgcacugagaaugccuacguguccguggucucaagccauuauagucgaaaguuuacccccgaaauagcuaagcguccuaaaguuagagaucaggaggggaggaucaacuacuauuggacacuguuggagccaggagacacuauuaucuucgaagcaaaugguaaccucauugccccgcgguacgcuuuugcccugucucgcggcuucggguccggaaucauaaauagcaacgcgcccauggauaagugugacgcaaaaugccagaccccucaaggcgccauuaauucgucuuuaccauuucagaacgugcaccccguaacaaucggugaguguccuaaguaugugagauccgcuaaacugaggauggucaccgggcuccggaauauuccaucaauccagagucgcggacuuuucggcgccaucgcaggcuuuauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguucacugccgucgggaaggaguuuaacaaacuggagcgaagaauggaaaacuugaauaagaaaguggaugacggcuucaucgauauauggacauacaacgcagagcuacugguacuccuggaaaaugagaggacccuugacuuccacgacagcaacguuaagaaucuguaugaaaaagugaagucacaauugaagaacaaugcuaaagagauuggaaacggcugcuuugaguucuaccauaaguguaauaacgaaugcauggagagugucaaaaaugggacguaugauuaccccaaguauuccgaagagagcaaacucaaccgggagaagaucgacggagugaagcuggaaucuaugggugucuaccagaucuuagccauuuauucaaccguggcuaguagccugguucuacucgugucccugggcgccaucucuuuuuggaugugcucgaaugggagccuucagugucguauuugcauauga

SEQ ID NO: 127993 - RNA, 1698 nt, Artificial Sequence
  derived and/or modified sequence opt3 from hemagglutinin__InfluenzaA__ADN89391
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuauaaaaacuuacuguggcuuaccggaaagaauggcuuguaccccaaccugaguaaaagcuaugcaaauaacaaggagaaagaagugcuaguucucuggggcgugcaccacccuccagacaucggggaucagaagacgcuguaccauacugagaacgccuacgucucugugguguccucacacuauagccgcaaguucacccccgaaauagcuaaacgaccuaagguccgugaccaggagggaagaaucaauuacuauuggacacuucuggagccaggugauacuauuaucuuugaagcaaacggcaauuugauugccccgagguacgcuuucgcccucagucggggguuuggaucuggcaucauaaacuccaaugcgcccauggacaaaugugaugcaaagugccagaccccucaaggugccauuaacagcucgcugccauuccagaauguucaucccgugacaaucggggaguguccuaaauauguacgcucugcuaaguuaagaauggugaccggacugaggaacauuccauccauccagucacggggccucuuuggcgccaucgcaggguucauugaaggagguuggacgggcauggucgacgggugguacggauaucaccaccagaaugagcaaggcagugguuacgcugccgaucagaaaagcacucagaacgcgauaaaugggaucacaaacaagguaaauuccguuauugaaaagaugaacacccaguuuacugccgugggcaaagaguucaauaaacuugagcgccgaauggaaaaccugaacaaaaaggucgacgauggauucaucgacauauggacauacaaugcagaguugcuagugcugcucgaaaacgagagaacccuggacuuucaugauucuaauguaaagaaccuuuaugaaaagguuaagagccaacugaaaaauaacgcuaaggagauuggcaaugggugcuucgaguuuuaccacaaauguaacgacgaaugcauggagucagugaagaauggaacguaugauuaccccaaauauagugaagaguccaaguugaacagggagaagaucgacggugucaaacucgaaagcaugggcguguaccagauccuggccauuuauucuaccgucgcuucaaguuuagugcugcuaguuagccucggggccaucuccuucuggaugugcucuaauggaucgcugcagugucggauuugcauauga

SEQ ID NO: 127994 - RNA, 1698 nt, Artificial Sequence
  derived and/or modified sequence opt3 from hemagglutinin__InfluenzaA__ADN89402
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaaaagagcugguccuacaucguugagaagccaaacccggaaaauggaaccuguuaucccggccauuuugcugauuacgaggagcugaaagaacaacucucuucggugagcucauucgagagauuugaaauuuucccuaaggagaguuccuggccaaaccacacugucacaggugugucugccagcugcucccauaauggggagucaaguuuuuauaggaacuuacuguggcuuaccggcaaaaauggauuguaccccaaccugagcaagucuuaugcaaauaacaaagaaaaggagguucuaguacucuggggcgugcaccacccuccaaacaucgucgaccagaagacgcuguaccggacugaaaaugccuacguguccguggucucaagccauuauagucgcaaauucacccccgagauagcuaagcgaccuaaaguucgugaucaggaagggagaaucaacuacuauuggacacuucuggagccaggagacacuauuaucuuugaggcaaaugguaacuugauugccccgagguacgcuuucgcccucucucggggcuuuggguccggaaucauaaauagcaacgcgcccaugggcaagugugaugcaaaaugccagaccccucaaggugccauuaauucgucucugccauuccagaacgugcaccccguaacaaucggggaauguccuaaguaugugcgcuccgcuaaauuaagaauggucaccggacugaggaauauuccaucaauccagagucggggccucuuuggcgccaucgcaggguucauugagggagguuggacgggcaugguggacgggugguacggauaucaucaccagaacgaacaaggcagcgguuacgcugccgaucagaaguccacucagaaugcgauaaacgggaucacaaauaagguuaacucugugauugagaaaaugaauacccaguuuacugccgucggcaaggaguucaacaaacuugaacgccgaauggagaaccugaauaagaaaguggacgauggauucaucgacauauggacauacaacgcagaauugcuaguacugcucgagaaugaaagaacccuggauuuucacgacagcaacguuaagaaucuuuaugagaaggugaaaucacaacugaagaacaaugcuaaagaaauuggcaacgggugcuucgaguuuuaccauaaguguaaugacgagugcauggaaagugucaaaaacggaacguaugauuaccccaaguauuccgaggaaagcaaguugaauagggagaaaaucgacggugugaagcucgagucuaugggcgucuaccagauccuggccauuuauucaaccguggcuaguagcuuaguucugcuagugucccucggggccaucucuuucuggaugugcucgaacggaagccugcagugucggauuugcauauga

SEQ ID NO: 127995 - RNA, 1698 nt, Artificial Sequence; identical to SEQ ID NO: 127956
  derived and/or modified sequence opt3 from hemagglutinin__InfluenzaA__ADN89413

SEQ ID NO: 127996 - RNA, 1698 nt, Artificial Sequence; identical to SEQ ID NO: 127529
  derived and/or modified sequence opt3 from hemagglutinin__InfluenzaA__ADN89424

SEQ ID NO: 127997 - RNA, 1698 nt, Artificial Sequence
  derived and/or modified sequence opt3 from hemagglutinin__InfluenzaA__ADN89435
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacgccaaaugccagaccccucaaggcgcuauuaacagcucgcugccauuccagaauguucaucccgugacaaucggugaguguccuaaguauguacgcucugccaaauuaagaauggugaccgggcugaggaacauuccauccauccagucacggggacucuuuggcgcaaucgcuggcuucauugaagggggauggacggguauggucgauggcugguacggguaucaccaccagaaugagcaaggaaguggcuacgccgcggaccagaaaagcacucagaacgccauaaaugguaucacaaacaaaguaaauuccguuauugaaaagaugaacacccaguuuacugcaguggggaaggaguucaacaaacuugagcgccgaauggaaaaucugaacaagaaagucgaugacggcuucaucgauauauggacauacaaugcugaguugcuagugcugcucgaaaacgagagaacccuggacuuucaugacucuaauguaaagaaccuuuaugaaaaaguuaagagccaacugaagaauaacgccaaagagauuggaaauggcugcuucgaguuuuaccacaaguguaacgaugaaugcauggagucagugaaaaaugggacguaugacuaccccaaguauagugaagaguccagguugaaccgggagaaaaucgauggagucaagcucgaaagcauggguguguaccagauccuggcuauuuauucuaccgucgccucaaguuuagugcugcuaguuagccucggcgcaaucuccuucuggaugugcucuaaugggucgcugcagugucguauuugcauauga

SEQ ID NO: 127998 - RNA, 1698 nt, Artificial Sequence
  derived and/or modified sequence opt3 from hemagglutinin__InfluenzaA__ADN89446
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaaaacucucacaaugggaaacuaugccuccugaagggaauagcgccccuucagcuggguaacuguucagucgcuggcuggaucuuggggaauccugagugcgaacuccugauuaguaaagagagcugguccuacaucguggaaaagccaaacccggagaauggaaccuguuaucccggccauuuugccgauuacgaggaacugagagagcaacucucuucgguuagcucauucgaaagguuugagauuuucccuaaggagaguuccuggccaaaccacacugugacaggugucucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcugaccagaaaacgcuguaccauacugagaacgcauacgugucugucguguccucacacuauagccgcaaguucacccccgaaauagccaagcgaccuaaagugcgugaucaggaggggagaaucaauuacuauuggacacuucuggagccaggagacacuauuaucuuugaagcuaacgguaauuugauugccccgagguacgcguucgcacucagucggggcuuugggucuggaaucauaaacuccaaugcccccauggauaagugugacgcuaaaugccagaccccucaaggcgccauuaacagcucgcugccauuccagaauguccaucccguuacaaucggugaguguccuaaguaugugcgcucugcaaaauuaagaaugguaaccgggcugaggaacauuccauccauccagucacggggacucuuuggcgcuaucgccggcuucauugaagggggauggacggguaugguggauggcugguacggguaucaccaccagaaugagcaaggaaguggcuacgcggccgaccagaaaagcacucagaacgcaauaaaugguaucacaaacaaagucaauuccgugauugaaaagaugaacacccaguuuacugcuguugggaaggaguucaacaaacuugagcgccgaauggaaaaucugaacaagaaaguggaugacggcuucaucgauauauggacauacaaugccgaguugcuaguccugcucgaaaacgagagaacccuggacuuucaugacucuaaugugaagaaccuuuaugaaaaaguaaagagccaacugaagaauaacgcuaaagagauuggaaauggcugcuucgaguuuuaccacaaguguaacgaugaaugcauggagucaguuaaaaaugggacguaugacuaccccaaguauagugaagaguccaaauugaacagggagaagaucgauggagugaagcucgaaagcaugggugucuaccagauccuggccauuuauucuaccguggcaucaaguuuaguccugcuagugagccucggcgccaucuccuucuggaugugcucuaaugggucgcugcagugucggauuugcauauga

SEQ ID NO: 127999 - RNA, 1698 nt, Artificial Sequence; identical to SEQ ID NO: 127529
  derived and/or modified sequence opt3 from hemagglutinin__InfluenzaA__ADN89457

SEQ ID NO: 128000 - RNA, 1698 nt, Artificial Sequence
  derived and/or modified sequence opt3 from hemagglutinin__InfluenzaA__ADN89468
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggacaguuccuggccaaaccacacugucacaggugugucugccagcugcucccauaauggggagucaaguuuuuaucggaacuuacuguggcuuaccggcaaaaauggauuguaccccaaccugagcaagucuuaugcaaauaacaaagaaaaggagguucuaguacucuggggcgugcaccacccuccauccaucaacgaucagaaaacgcuguaccauacugaaaaugccuacgucucaguggugagcagucacuauucucgcaaguucacccccgagauagcuaagcgaccuaaaguccgugaccaggaagggagaaucaacuacuauuggacacuucuggagccaggagauacuauuaucuuugaggcaaaugguaacuugauugccccgagguacgcuuucgcccucucccggggcuuugggagcggaaucauaaauucgaacgcgcccauggacaagugugaugcaaaaugccagaccccucaaggcgccauuaauucuucccugccauuccagaacguucaucccgugacaaucggugaauguccuaaguauguacgcucagcuaaauuaagaauggugaccgggcugaggaauauuccaaguauccagagccggggacucuuuggcgccaucgcaggcuucauugaagggggauggacggguauggucgacggcugguacggguaucaccaccagaacgaacaaggauccggcuacgcugccgaucagaagucuacucagaaugcgauaaacgguaucacaaauaaagugaacagcguuauugagaagaugaauacccaguuuacugccguggggaaggaguucucaaaacuugagcgccgaauggagaaccugaacaagaaagucgacgauggcuucaucgacauauggacauacaaugcagaauugcuagugcugcucgagaacgaaagaacccuggacuuucaugauaguaauguaaagaaccuuuaugagaaaguuaagucccaacugaagaauaacgcuaaagaaauuggaaauggcugcuucgaguuuuaccacaaguguaacgacgagugcauggaaagcgugaaaaaugggacguaugauuaccccaaguauucugaggaaucaaaauugaacagggagaagaucgacggagucaagcucgagaguauggguguguaccagauccugaccauuuauagcacagucgccuccucuuuagugcugcuaaucucgcucggcgcuauuagcuucuggaugugcuccaaugggucacugcagugucggauaugcaucuga

SEQ ID NO: 128001 - RNA, 1698 nt, Artificial Sequence; identical to SEQ ID NO: 127958
  derived and/or modified sequence opt3 from hemagglutinin__InfluenzaA__ADN89479

SEQ ID NO: 128002 - RNA, 1698 nt, Artificial Sequence; identical to SEQ ID NO: 127958
  derived and/or modified sequence opt3 from hemagglutinin__InfluenzaA__ADN89490

SEQ ID NO: 128003 - RNA, 1698 nt, Artificial Sequence; identical to SEQ ID NO: 127981
  derived and/or modified sequence opt3 from hemagglutinin__InfluenzaA__ADN89501

SEQ ID NO: 128004 - RNA, 1698 nt, Artificial Sequence; identical to SEQ ID NO: 127969
  derived and/or modified sequence opt3 from hemagglutinin__InfluenzaA__ADN89512

SEQ ID NO: 128005 - RNA, 1698 nt, Artificial Sequence; identical to SEQ ID NO: 127983
  derived and/or modified sequence opt3 from hemagglutinin__InfluenzaA__ADN89523

SEQ ID NO: 128006 - RNA, 1698 nt, Artificial Sequence; identical to SEQ ID NO: 127992
  derived and/or modified sequence opt3 from hemagglutinin__InfluenzaA__ADN89534

SEQ ID NO: 128007 - RNA, 1698 nt, Artificial Sequence; identical to SEQ ID NO: 127997
  derived and/or modified sequence opt3 from hemagglutinin__InfluenzaA__ADN89545

SEQ ID NO: 128008 - RNA, 1698 nt, Artificial Sequence; identical to SEQ ID NO: 125642
  derived and/or modified sequence opt3 from hemagglutinin__InfluenzaA__ADN89556

SEQ ID NO: 128009 - RNA, 1698 nt, Artificial Sequence; identical to SEQ ID NO: 127958
  derived and/or modified sequence opt3 from hemagglutinin__InfluenzaA__ADN89567

SEQ ID NO: 128010 - RNA, 1698 nt, Artificial Sequence
  derived and/or modified sequence opt3 from hemagglutinin__InfluenzaA__ADN89578
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugagcagcuuugaaagguucgagauuuuuccuaaggguaguuccuggccaaaccacacugucacaggggugucugccagcugcucccauaauggagagaacucauucuaucggaaucugcuuugguugaccggcaaaaacggccuguaccccaaucuaaguaagagcuaugcaaacaacaaagaaaaggagguacuccugcuuuggggaguucaccacccuccaaauaucgccgaccagaaaacgcuguaccauacugaaaacgcuuacgugucugucguguccucacacuauagccgcaaguuuacccccgagauagcaaagcgaccuaaagugcgugaucaggaagggagaaucaauuacuauuggacauugcucgagccaggugacacuauuaucuucgaggccaacggcaaucugauugcuccgagguacgccuuugcguuaagucggggguucggaucuggcaucauaaacuccaaugcacccauggauaagugugacgccaaaugccagaccccucaaggugcuauuaacagcucgcugccauuucagaauguccaucccguuacaaucggggaauguccuaaguaugugcgcucugccaaacucagaaugguaaccggacuuaggaacauuccauccauccagucacggggccuguucggcgcaaucgcuggguuuauugagggagguuggacgggcaugguggaugggugguacggauaucaccaccagaaugaacaaggcagugguuacgccgcggaccagaagucaacucagaacgccauaaaugggaucacaaacaaagucaauuccgugauugagaagaugaacacccaguucacugcaguuggcaaggaauuuaacaaauuggagcgccgaauggagaaucuaaacaagaaaguggaugacggauucaucgauauauggacauacaaugcugaacugcucguccugcuugagaacgaaagaacccuggacuuccaugacucuaaugugaagaacuuguaugagaaaguaaagagccaacucaagaauaacgccaaagaaauuggcaaugggugcuuugaguucuaccacaaguguaacgaugagugcauggaaucaguuaaaaauggaacguaugacuaccccaaguauagugaggaauccaaacugaacagggagaagaucgauggugugaaguuagagagcaugggcgucuaccagauccuggcuauuuauucuaccguggccucaagucuaguccuccuggugagccuuggggcaaucuccuuuuggaugugcucuaauggaucguugcagugucggauuugcauauga

SEQ ID NO: 128011 - RNA, 1698 nt, Artificial Sequence; identical to SEQ ID NO: 127529
  derived and/or modified sequence opt3 from hemagglutinin__InfluenzaA__ADN89589

SEQ ID NO: 128012 - RNA, 1698 nt, Artificial Sequence
  derived and/or modified sequence opt3 from hemagglutinin__InfluenzaA__ADN89600
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuacccgcaaaaauggauuguaccccaaccugagcaagucuuaugcaaauaacaaagagaaggaaguucuaguacucuggggcgugcaccacccuccaaacauggucgaccagaaaacgcuguaccgaacugagaaugccuacguguccguggucucaagccauuauagucguaaguucacccccgaaaucgcuaagagaccuaaaguuagggaucaggagggccggauaaacuacuauuggacacuucuggagccaggggacacuaucauuuuugaagcaaauggaaacuugaucgccccgcgcuacgcuuucgcccucucuagagguuuuggcuccgggauuaucaauagcaacgcgcccaugggaaagugugaugcaaaaugccagaccccucaaggcgccauaaauucgucucugccauuccagaacgugcaccccguaacaauuggugaguguccuaaguaugugagguccgcuaaauuacggauggucaccgggcugcgcaauaucccaucaauucagagucgaggacucuuuggcgccaucgcaggcuucaucgaagggggauggacggguaugguggacggcugguacggguaucaucaccagaacgagcaaggaagcggcuacgcugccgaucagaaguccacucagaaugcgauuaacgguauaacaaauaaaguuaacucugugaucgaaaagaugaauacccaguuuacugccgucgggaaggaguucaacaaacuugagagaaggauggaaaaccugaauaagaaaguggacgauggcuucauugacaucuggacauacaacgcagaguugcuaguacugcucgaaaaugagcggacccuggauuuucacgacagcaacguuaagaaucuuuaugaaaaagugaagucacaacugaagaacaaugcuaaagagauaggaaacggcugcuucgaguuuuaccauaaguguaaugacgaaugcauggagagugucaaaaacgggacguaugauuaccccaaguauuccgaagagagcaaauugaaucgugagaagauugacggagugaagcucgaaucuaugggugucuaccagauccuggccaucuauucaaccguggcuaguagcuuaguucugcuagugucccucggcgccauuucuuucuggaugugcucgaacgggagccugcagugucgcaucugcauuuga

SEQ ID NO: 128013 - RNA, 1698 nt, Artificial Sequence; identical to SEQ ID NO: 127529
  derived and/or modified sequence opt3 from hemagglutinin__InfluenzaA__ADN89611

SEQ ID NO: 128014 - RNA, 1698 nt, Artificial Sequence; identical to SEQ ID NO: 127956
  derived and/or modified sequence opt3 from hemagglutinin__InfluenzaA__ADN89622

SEQ ID NO: 128015 - RNA, 1698 nt, Artificial Sequence; identical to SEQ ID NO: 127997
  derived and/or modified sequence opt3 from hemagglutinin__InfluenzaA__ADN89633

SEQ ID NO: 128016 - RNA, 1698 nt, Artificial Sequence; identical to SEQ ID NO: 127981
  derived and/or modified sequence opt3 from hemagglutinin__InfluenzaA__ADN89644

SEQ ID NO: 128017 - RNA, 1698 nt, Artificial Sequence; identical to SEQ ID NO: 127997
  derived and/or modified sequence opt3 from hemagglutinin__InfluenzaA__ADN89655

SEQ ID NO: 128018 - RNA, 1698 nt, Artificial Sequence; identical to SEQ ID NO: 127529
  derived and/or modified sequence opt3 from hemagglutinin__InfluenzaA__ADN89666

SEQ ID NO: 128019 - RNA, 1698 nt, Artificial Sequence; identical to SEQ ID NO: 127969
  derived and/or modified sequence opt3 from hemagglutinin__InfluenzaA__ADN89677

SEQ ID NO: 128020 - RNA, 1698 nt, Artificial Sequence; identical to SEQ ID NO: 127969
  derived and/or modified sequence opt3 from hemagglutinin__InfluenzaA__ADN89688

SEQ ID NO: 128021 - RNA, 1698 nt, Artificial Sequence; identical to SEQ ID NO: 127956
  derived and/or modified sequence opt3 from hemagglutinin__InfluenzaA__ADN89699

SEQ ID NO: 128022 - RNA, 1698 nt, Artificial Sequence; identical to SEQ ID NO: 127958
  derived and/or modified sequence opt3 from hemagglutinin__InfluenzaA__ADN89710

SEQ ID NO: 128023 - RNA, 1698 nt, Artificial Sequence; identical to SEQ ID NO: 127981
  derived and/or modified sequence opt3 from hemagglutinin__InfluenzaA__ADN89721

SEQ ID NO: 128024 - RNA, 1698 nt, Artificial Sequence; identical to SEQ ID NO: 127958
  derived and/or modified sequence opt3 from hemagglutinin__InfluenzaA__ADN89732

SEQ ID NO: 128025 - RNA, 1698 nt, Artificial Sequence; identical to SEQ ID NO: 127958
  derived and/or modified sequence opt3 from hemagglutinin__InfluenzaA__ADN89743

SEQ ID NO: 128026 - RNA, 1698 nt, Artificial Sequence; identical to SEQ ID NO: 127983
  derived and/or modified sequence opt3 from hemagglutinin__InfluenzaA__ADN89765

SEQ ID NO: 128027 - RNA, 1698 nt, Artificial Sequence
  derived and/or modified sequence opt3 from hemagglutinin__InfluenzaA__ADN89776
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccauccaucucagaccagaaaacgcuguaccauacugagaacgccuacgucagcguggugaguucucacuauucccgcaaguucacccccgaagucgcuaagcgaccuaaaguucgugaucaggaggggagaauaaauuacuauuggacacuucuggagccaggagacacuaucauuuuugaagcaaacgguaauuugaucgccccgagguacgcuuucgcccucagccggggcuuugggucgggaauuaucaacucuaaugcgcccauggauaagugugacgcaaaaugccagaccccucaaggcgccauaaacuccucacugccauuccagaaugugcaucccguaacaauuggugaguguccuaaguaugugcgcagugcuaaauuaagaauggucaccgggcugaggaacaucccaagcauucagucccggggacucuuuggcgccaucgcaggcuucaucgaagggggauggacggguaugguggauggcugguacggguaucaccaccagaaugagcaaggaucuggcuacgcugccgaccagaaaagcacucagaacgcgauuaaugguauaacaaacaaaguuaauucagugaucgaaaagaugaacacccaguuuacugccgucgggaaggaguucaauaaacuugagcgccgaauggaaaaccugaacaagaaaguggaugacggcuucauugauaucuggacauacaaugcagaguugcuaguacugcucgaaaacgagagaacccuggacuuucaugacaguaauguuaagaaccuuuaugaaaaagugaagucccaacugaagaauaacgcuaaagagauaggaaauggcugcuucgaguuuuaccacaaguguaacgaugaaugcauggagagcgucaaaaaugggacguaugacuaccccaaguauucugaagagucaaaauugaacagggagaagauugauggagugaagcucgaaaguaugggugucuaccagauccuggccaucuauagcaccguggcuuccucuuuaguucugcuagugucgcucggcgccauuagcuucuggaugugcuccaaugggucacugcagugucggaucugcauuuga

SEQ ID NO: 128028 - RNA, 1698 nt, Artificial Sequence; identical to SEQ ID NO: 127969
  derived and/or modified sequence opt3 from hemagglutinin__InfluenzaA__ADN89787

SEQ ID NO: 128029 - RNA, 1698 nt, Artificial Sequence; identical to SEQ ID NO: 127983
  derived and/or modified sequence opt3 from hemagglutinin__InfluenzaA__ADN89798

SEQ ID NO: 128030 - RNA, 1698 nt, Artificial Sequence; identical to SEQ ID NO: 127529
  derived and/or modified sequence opt3 from hemagglutinin__InfluenzaA__ADN89809

SEQ ID NO: 128031 - RNA, 1698 nt, Artificial Sequence; identical to SEQ ID NO: 127529
  derived and/or modified sequence opt3 from hemagglutinin__InfluenzaA__ADN89820

SEQ ID NO: 128032 - RNA, 1698 nt, Artificial Sequence; identical to SEQ ID NO: 127529
  derived and/or modified sequence opt3 from hemagglutinin__InfluenzaA__ADN89831

SEQ ID NO: 128033 - RNA, 1698 nt, Artificial Sequence
  derived and/or modified sequence opt3 from hemagglutinin__InfluenzaA__ADN89842
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacagacacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugauuacgaggaacugagggagcaacucuccucugugucgucauucgaacgguuugagauuuucccuaaggagagcaguuggccaaaccacacugucacagguguguccgccucuugcagccauaauggggaauccucauuuuaucgcaacuuacuguggcuuaccggaaagaauggcuuguaccccaaccugaguaagagcuaugcaaauaacaaagagaaggaagugcuaguucucuggggcgugcaccacccuccaaacaucgucgaccagaaaacgcuguaccgaacugagaaugccuacgugucuguggucuccucacauuauagccguaaguucacccccgaaauagcuaagagaccuaaaguuagggaucaggaggggcggaucaacuacuauuggacacuucuggagccaggagacacuauuaucuuugaagcaaaugguaacuugauugccccgcgcuacgcuuucgcccucaguagaggcuuugggucuggaaucauaaauuccaacgcgcccauggauaagugugacgcaaaaugccagaccccucaaggcgccauuaauagcucgcugccauuccagaacgugcaccccguaacaaucggugaguguccuaaguaugugaggucugcuaaauuacggauggucaccgggcugcgcaauauuccauccauccagucacgaggacucuuuggcgccaucgcaggcuucauugaagggggauggacggguaugguggauggcugguacggguaucaucaccagaacgagcaaggaaguggcuacgcugccgaccagaaaagcacucagaaugcgauaaacgguaucacaaauaaaguuaacuccgugauugaaaagaugaauacccaguuuacugccgucgggaaggaguucaacaaacuugagagaaggauggaaaaccugaauaagaaaguggaugacggcuucaucgauauauggacauacaacgcagaguugcuaguacugcucgaaaaugagcggacccuggacuuucacgacucuaacguuaagaaucuuuaugaaaaaguaaagagccaacugaagaacaaugcuaaagagauuggaaacggcugcuucgaguuuuaccauaaguguaaugaugaaugcauggagucagucaaaaacgggacguaugacuaccccaaguauagugaagaguccaaauugaaucgugagaagaucgauggagugaagcucgaaagcaugggugucuaccagauccuggccauuuauucuaccguggcuucaaguuuaguucugcuagugagccucggcgccaucuccuucuggaugugcucuaacgggucgcugcagugucgcauuugcauauga

SEQ ID NO: 128034 - RNA, 1701 nt, Artificial Sequence; identical to SEQ ID NO: 127549
  derived and/or modified sequence opt3 from hemagglutinin__InfluenzaA__ADN89864

SEQ ID NO: 128035 - RNA, 1701 nt, Artificial Sequence; identical to SEQ ID NO: 127549
  derived and/or modified sequence opt3 from hemagglutinin__InfluenzaA__ADN89875

SEQ ID NO: 128036 - RNA, 1701 nt, Artificial Sequence
  derived and/or modified sequence opt3 from hemagglutinin__InfluenzaA__ADN89886
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaguacacugaaacuugcuaccgggaugaggaaugugccagagaagcagacucggggaaucuucggcgccauugcaggcuuuaucgaaaacgggugggagggaauggucgaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguugaagggaggauccaagaccuggagaaguacguggaggauacgaaaaucgacuuauggagcuauaacgcagaacugcucguagcucuugagaaucagcauaccauugaucugacagacucagaaaugaacaaguuguucgagaaaacucggaagcagcuacgagaaaaugccgaggauaugggcaacggaugcuuuaccauauaccacaaaugugacaaugcuugcaucggcaguauucgcaacgggacauaugaucauaauguguacagagacgaggcccugaacaauagguuccagaucaagggagucgaacucaaguccgguuacaaagacuggauucuguggaucagcuuugcaauaucuugcuuccuucuguguguggccuugcucggcuuuaucaugugggcuugccaaaaggggaacauucgguguaauaucugcauuuga

SEQ ID NO: 128037 - RNA, 1701 nt, Artificial Sequence; identical to SEQ ID NO: 127549
  derived and/or modified sequence opt3 from hemagglutinin__InfluenzaA__ADN89897

SEQ ID NO: 128038 - RNA, 1701 nt, Artificial Sequence; identical to SEQ ID NO: 127549
  derived and/or modified sequence opt3 from hemagglutinin__InfluenzaA__ADN89908

SEQ ID NO: 128039 - RNA, 1701 nt, Artificial Sequence; identical to SEQ ID NO: 127549
  derived and/or modified sequence opt3 from hemagglutinin__InfluenzaA__ADN89919

SEQ ID NO: 128040 - RNA, 1701 nt, Artificial Sequence; identical to SEQ ID NO: 127549
  derived and/or modified sequence opt3 from hemagglutinin__InfluenzaA__ADN89930

SEQ ID NO: 128041 - RNA, 1701 nt, Artificial Sequence; identical to SEQ ID NO: 127549
  derived and/or modified sequence opt3 from hemagglutinin__InfluenzaA__ADN89941

SEQ ID NO: 128042 - RNA, 1701 nt, Artificial Sequence; identical to SEQ ID NO: 127549
  derived and/or modified sequence opt3 from hemagglutinin__InfluenzaA__ADN89952

SEQ ID NO: 128043 - RNA, 1701 nt, Artificial Sequence; identical to SEQ ID NO: 127549
  derived and/or modified sequence opt3 from hemagglutinin__InfluenzaA__ADN89963

SEQ ID NO: 128044 - RNA, 1701 nt, Artificial Sequence
  derived and/or modified sequence opt3 from hemagglutinin__InfluenzaA__ADN89974
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccaguccgggaaaagcucgauuaugcggucugacgcacccaucggaaaguguaacuccgaaugcauaacgccuaauggcucaauuccaaacgacaagcccuuucaaaaugucaaccgcaucacuuauggugccuguccucgauacgugaaacagaguacacugaaacuugcuaccgggaugagaaaugugccagagaagcagacuaggggaaucuucggcgccauugcaggcuuuaucgaaaacgggugggagggaauggucgaugguugguauggcuuccggcaccaaaauagcgaggggcguggacaggcugccgaccugaaguccacacaggcggccauugaucagauaaacggcaaauugaaucgccucaucgguaagaccaacgaaaaauuccaccaaauugagaaggaauuuucugagguugaagggagaauccaggaccuggagaaguacguggaggauacgaaaaucgacuuauggagcuauaacgcagaacugcucguagcucuugagaaucagcauaccauugaucugacagacucagaaaugaacaaguuguucgagaaaacuaagaaacagcuaagggaaaaugccgaggauaugggcaacggaugcuuuaccauauaccacaagugugacaaugcuugcaucggcaguauucggaacgggacauaugaucauaauguguaccgagacgaggcccugaacaaucgcuuccaaaucaagggagucgaacucaaauccgguuacaaggacuggauucuguggaucagcuuugcaauaucuugcuuccuucuguguguggccuugcucggcuuuaucaugugggcuugccagaaagggaacauuagauguaauaucugcauuuga

SEQ ID NO: 128045 - RNA, 1701 nt, Artificial Sequence; identical to SEQ ID NO: 127549
  derived and/or modified sequence opt3 from hemagglutinin__InfluenzaA__ADN89985

SEQ ID NO: 128046 - RNA, 1701 nt, Artificial Sequence; identical to SEQ ID NO: 127549
  derived and/or modified sequence opt3 from hemagglutinin__InfluenzaA__ADN89996

SEQ ID NO: 128047 - RNA, 1701 nt, Artificial Sequence; identical to SEQ ID NO: 127549
  derived and/or modified sequence opt3 from hemagglutinin__InfluenzaA__ADN90007

SEQ ID NO: 128048 - RNA, 1701 nt, Artificial Sequence; identical to SEQ ID NO: 127549
  derived and/or modified sequence opt3 from hemagglutinin__InfluenzaA__ADN90018

SEQ ID NO: 128049 - RNA, 1701 nt, Artificial Sequence; identical to SEQ ID NO: 127549
  derived and/or modified sequence opt3 from hemagglutinin__InfluenzaA__ADN90040

SEQ ID NO: 128050 - RNA, 1701 nt, Artificial Sequence; identical to SEQ ID NO: 127549
  derived and/or modified sequence opt3 from hemagglutinin__InfluenzaA__ADN90051

SEQ ID NO: 128051 - RNA, 1701 nt, Artificial Sequence; identical to SEQ ID NO: 127549
  derived and/or modified sequence opt3 from hemagglutinin__InfluenzaA__ADN90062

SEQ ID NO: 128052 - RNA, 1701 nt, Artificial Sequence; identical to SEQ ID NO: 127549
  derived and/or modified sequence opt3 from hemagglutinin__InfluenzaA__ADN90073

SEQ ID NO: 128053 - RNA, 1701 nt, Artificial Sequence; identical to SEQ ID NO: 127549
  derived and/or modified sequence opt3 from hemagglutinin__InfluenzaA__ADN90084

SEQ ID NO: 128054 - RNA, 1701 nt, Artificial Sequence; identical to SEQ ID NO: 127549
  derived and/or modified sequence opt3 from hemagglutinin__InfluenzaA__ADN90095

SEQ ID NO: 128055 - RNA, 1701 nt, Artificial Sequence; identical to SEQ ID NO: 127549
  derived and/or modified sequence opt3 from hemagglutinin__InfluenzaA__ADN90106

SEQ ID NO: 128056 - RNA, 1701 nt, Artificial Sequence; identical to SEQ ID NO: 127549
  derived and/or modified sequence opt3 from hemagglutinin__InfluenzaA__ADN90117

SEQ ID NO: 128057 - RNA, 1701 nt, Artificial Sequence; identical to SEQ ID NO: 127549
  derived and/or modified sequence opt3 from hemagglutinin__InfluenzaA__ADN90128

SEQ ID NO: 128058 - RNA, 1701 nt, Artificial Sequence; identical to SEQ ID NO: 127549
  derived and/or modified sequence opt3 from hemagglutinin__InfluenzaA__ADN90139

SEQ ID NO: 128059 - RNA, 1701 nt, Artificial Sequence; identical to SEQ ID NO: 127549
  derived and/or modified sequence opt3 from hemagglutinin__InfluenzaA__ADN90150

SEQ ID NO: 128060 - RNA, 1701 nt, Artificial Sequence; identical to SEQ ID NO: 127549
  derived and/or modified sequence opt3 from hemagglutinin__InfluenzaA__ADN90161

SEQ ID NO: 128061 - RNA, 1701 nt, Artificial Sequence; identical to SEQ ID NO: 127549
  derived and/or modified sequence opt3 from hemagglutinin__InfluenzaA__ADN90172

SEQ ID NO: 128062 - RNA, 1701 nt, Artificial Sequence; identical to SEQ ID NO: 127549
  derived and/or modified sequence opt3 from hemagglutinin__InfluenzaA__ADN90183

SEQ ID NO: 128063 - RNA, 1701 nt, Artificial Sequence; identical to SEQ ID NO: 127549
  derived and/or modified sequence opt3 from hemagglutinin__InfluenzaA__ADN90194

SEQ ID NO: 128064 - RNA, 1701 nt, Artificial Sequence; identical to SEQ ID NO: 127549
  derived and/or modified sequence opt3 from hemagglutinin__InfluenzaA__ADN90205

SEQ ID NO: 128065 - RNA, 1701 nt, Artificial Sequence; identical to SEQ ID NO: 127549
  derived and/or modified sequence opt3 from hemagglutinin__InfluenzaA__ADN90216

SEQ ID NO: 128066 - RNA, 1701 nt, Artificial Sequence; identical to SEQ ID NO: 125446
  derived and/or modified sequence opt3 from hemagglutinin__InfluenzaA__ADN92467

SEQ ID NO: 128067 - RNA, 1701 nt, Artificial Sequence
  derived and/or modified sequence opt3 from hemagglutinin__InfluenzaA__ADN92478
augaagaccaucauugcccugagccacauacucugccuuguguucgcucagaaacugcccggcaacgacaauuccacagcaacuuuguguuuagggcaucacgccgucccuaacggaacgaucguuaagaccauuacaaaugaucaaaucgaggugacuaacgcgaccgaacugguacagucuucaaguacaggugagauuugcgacagcccacaucagauccuagauggcaaaaauuguacccucauagacgcucugcuuggggauccgcagugcgacggauuucaaaacaagaaaugggaucuguucguggaaagauccaaggccuacucuaauuguuaucccuacgacgucccugauuaugcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucacuuaaacuuuaaauaccaggcacugaaugugaccaugccaaacaacgagcaguucgacaagcuguauauuuggggaguccaucaccccggcacagauaaagaccaaaucuuuuuguacgcccaggcuagcggccguauuacugugucuaccaagagaucccagcagacaguaaucccuaauauagggucaaggccacggguucgcaacauucccagcagaaucaguauuuauuggaccaucgugaaaccuggagauauccugcuaauuaauucuacggguaaccucauagccccaaggggcuacuucaagauccaauccggaaagagcucgauuaugcggucugacgcgccgaucgggaaauguaauuccgagugcauaacucccaacggcucaauuccuaaugacaagccauuucagaacgucaaucgcaucacauacggugcauguccccgauaugugaaacagaacacccugaaacuugccacugggaugagaaaugugccugaaaaacaaacaaggggaaucuucggcgcuauugccggcuuuaucgagaacgggugggaaggaauggucgaugguugguacggcuuccggcaccagaauagugaggggcguggacaggcagcugaccuuaagagcacccaggccgcgauugaucaaauaaacggcaaauugaaucgccucaucgguaagacgaacgagaaguuccaucagauugaaaaagaguuuuccgaaguugaggggagaauccaggaccuggaaaaguauguggaggauaccaaaaucgacuuauggucuuacaacgccgagcugcucguagcacuugaaaaucagcacacaauugaucugacugacagcgagaugaacaaguuguucgaaaagaccaagaagcaacuaagggagaaugcugaagauaugggcaacggaugcuuuaaaauauaucauaagugugacaaugccugcaucggcucaauucggaacgggacauacgaucacgacguguaucgagacgaggcucugaauaaccgcuuccagaucaaaggagucgagcucaagagugguuacaaagauuggauucuguggaucuccuuugccauaagcugcuuccuucuguguguggcauugcucggcuuuaucaugugggccugccagaaggggaauauuagauguaacaucugcauuuga

SEQ ID NO: 128068 - RNA, 1701 nt, Artificial Sequence
  derived and/or modified sequence opt3 from hemagglutinin__InfluenzaA__ADN92489
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaaaacuucaauuggacagguguuacccagaacgggacguccucugcuugcauccggcgcagcaaaaauuccuuuuucucacgacugaacuggcucacucauuuaaauuuuaaauaucaggcacugaacgugaccaugccaaacaaugagcaguucgacaaacuuuacauuuggggaguccaccaucccggcacagauaaggaccaaaucuuuuuguaugcccaggcuaguggccguauuacugugagcaccaagagaucucagcagacaguaaucccuaacauaggguccaggccacggguucgcaauauucccucaagaaucagcauuuacuggaccaucgugaaaccuggagauauccugcuaauuaacaguacggguaaucucauagccccaaggggcuacuucaagauccaaucugggaaguccagcauuaugcggucggacgcgccgaucggaaaauguaacucugagugcauaacucccaauggcuccauuccuaacgacaagccauuucagaaugucaaccgcaucacauauggugcauguccccgauacgugaaacagaauacccugaaacuugccacugggaugagaaacgugccugaaaagcaaacaaggggaaucuucggcgcuauugccggcuuuaucgagaaugggugggaaggaauggucgaugguugguauggcuuccggcaccagaacucagaggggcguggacaggcagcugaccugaagaguacccaggccgcgauugaucaaauaaauggcaaauugaaccgccucaucgguaagacgaacgagaaguuccaccagauugaaaaagaguuuagcgaaguugaggggagaauccaggaccuggaaaaguacguggaggauaccaaaaucgacuuaugguccuauaaugccgagcugcucguagcacuugaaaaccagcauacaauugaucugacugacucugagaugaauaaguuguucgaaaagaccaagaagcaacuaagggagaacgcugaagauaugggcaauggaugcuuuaaaauauaccacaagugugacaacgccugcaucggcagcauucggaaugggacauaugaucaugacguguaccgagacgaggcucugaacaaucgcuuccagaucaaaggagucgagcucaagucagguuacaaagauuggauucuguggaucaguuuugccauauccugcuuccuucuguguguggcauugcucggcuuuaucaugugggccugccagaaggggaacauuagauguaauaucugcauuuga

SEQ ID NO: 128069 - RNA, 1701 nt, Artificial Sequence; identical to SEQ ID NO: 125446
  derived and/or modified sequence opt3 from hemagglutinin__InfluenzaA__ADN92500

SEQ ID NO: 128070 - RNA, 1701 nt, Artificial Sequence; identical to SEQ ID NO: 124685
  derived and/or modified sequence opt3 from hemagglutinin__InfluenzaA__ADN92510

SEQ ID NO: 128071 - RNA, 1701 nt, Artificial Sequence; identical to SEQ ID NO: 124685
  derived and/or modified sequence opt3 from hemagglutinin__InfluenzaA__ADN92520

SEQ ID NO: 128072 - RNA, 1701 nt, Artificial Sequence; identical to SEQ ID NO: 125787
  derived and/or modified sequence opt3 from hemagglutinin__InfluenzaA__ADN92530

SEQ ID NO: 128073 - RNA, 1701 nt, Artificial Sequence; identical to SEQ ID NO: 124927
  derived and/or modified sequence opt3 from hemagglutinin__InfluenzaA__ADN92540

SEQ ID NO: 128074 - RNA, 1701 nt, Artificial Sequence; identical to SEQ ID NO: 124685
  derived and/or modified sequence opt3 from hemagglutinin__InfluenzaA__ADN92550

SEQ ID NO: 128075 - RNA, 1701 nt, Artificial Sequence; identical to SEQ ID NO: 124685
  derived and/or modified sequence opt3 from hemagglutinin__InfluenzaA__ADN92560

SEQ ID NO: 128076 - RNA, 1701 nt, Artificial Sequence
  derived and/or modified sequence opt3 from hemagglutinin__InfluenzaA__ADO00730
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugaguguggaucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagaacgccgacgcguacguguucgucggaacuucucgcuauuccaagaaauuuaagccugaaauugcaauccgaccaaaagugcgugaucaggaggguagaaugaauuacuauuggacccugguggagcccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacgggaucacgaauaaggugaacucuguuauagaaaagaugaauacccaguuuacagcugugggcaaggaguucaaccaccuggagaagcggauugaaaauuuaaacaaaaaggucgaugacggauuccuggauaucuggacuuacaaugccgagcuccuugugcuguuggaaaacgagcgcacccuagacuaucaugauagcaauguuaaaaaccuguacgaaaagguacgaucacagcucaaaaacaaugcaaaggagaucggcaacggguguuuugaguucuaucacaagugcgacaauacauguauggaaagugugaaaaacggaacuuacgauuauccuaaguacuccgaggaagccaaacugaauagagaggaaauugacggugucaaacuugagagcaccaggaucuaucaaauucuggcuauauacucuacaguggcgucaaguuugguccucgugguuagccugggcgcaaucuccuuuuggaugugcucuaacgggucguuacagugccggauuuguaucuga

SEQ ID NO: 128077 - RNA, 1701 nt, Artificial Sequence; identical to SEQ ID NO: 126105
  derived and/or modified sequence opt3 from hemagglutinin__InfluenzaA__ADO00740

SEQ ID NO: 128078 - RNA, 1701 nt, Artificial Sequence; identical to SEQ ID NO: 125849
  derived and/or modified sequence opt3 from hemagglutinin__InfluenzaA__ADO00750

SEQ ID NO: 128079 - RNA, 1701 nt, Artificial Sequence; identical to SEQ ID NO: 124685
  derived and/or modified sequence opt3 from hemagglutinin__InfluenzaA__ADO12143

SEQ ID NO: 128080 - RNA, 1701 nt, Artificial Sequence; identical to SEQ ID NO: 124685
  derived and/or modified sequence opt3 from hemagglutinin__InfluenzaA__ADO12153

SEQ ID NO: 128081 - RNA, 1701 nt, Artificial Sequence; identical to SEQ ID NO: 124685
  derived and/or modified sequence opt3 from hemagglutinin__InfluenzaA__ADO12163

SEQ ID NO: 128082 - RNA, 1701 nt, Artificial Sequence; identical to SEQ ID NO: 124685
  derived and/or modified sequence opt3 from hemagglutinin__InfluenzaA__ADO12173

SEQ ID NO: 128083 - RNA, 1701 nt, Artificial Sequence; identical to SEQ ID NO: 124685
  derived and/or modified sequence opt3 from hemagglutinin__InfluenzaA__ADO12183

SEQ ID NO: 128084 - RNA, 1701 nt, Artificial Sequence; identical to SEQ ID NO: 124685
  derived and/or modified sequence opt3 from hemagglutinin__InfluenzaA__ADO12193

SEQ ID NO: 128085 - RNA, 1701 nt, Artificial Sequence; identical to SEQ ID NO: 124685
  derived and/or modified sequence opt3 from hemagglutinin__InfluenzaA__ADO12203

SEQ ID NO: 128086 - RNA, 1701 nt, Artificial Sequence; identical to SEQ ID NO: 124685
  derived and/or modified sequence opt3 from hemagglutinin__InfluenzaA__ADO12213

SEQ ID NO: 128087 - RNA, 1701 nt, Artificial Sequence; identical to SEQ ID NO: 124685
  derived and/or modified sequence opt3 from hemagglutinin__InfluenzaA__ADO12223

SEQ ID NO: 128088 - RNA, 1701 nt, Artificial Sequence; identical to SEQ ID NO: 124685
  derived and/or modified sequence opt3 from hemagglutinin__InfluenzaA__ADO12233

SEQ ID NO: 128089 - RNA, 1701 nt, Artificial Sequence; identical to SEQ ID NO: 124685
  derived and/or modified sequence opt3 from hemagglutinin__InfluenzaA__ADO12243

SEQ ID NO: 128090 - RNA, 1701 nt, Artificial Sequence; identical to SEQ ID NO: 124685
  derived and/or modified sequence opt3 from hemagglutinin__InfluenzaA__ADO12253

SEQ ID NO: 128091 - RNA, 1701 nt, Artificial Sequence; identical to SEQ ID NO: 124685
  derived and/or modified sequence opt3 from hemagglutinin__InfluenzaA__ADO12263

SEQ ID NO: 128092 - RNA, 1701 nt, Artificial Sequence; identical to SEQ ID NO: 124685
  derived and/or modified sequence opt3 from hemagglutinin__InfluenzaA__ADO12273

SEQ ID NO: 128093 - RNA, 1701 nt, Artificial Sequence; identical to SEQ ID NO: 124685
  derived and/or modified sequence opt3 from hemagglutinin__InfluenzaA__ADO12283

SEQ ID NO: 128094 - RNA, 1701 nt, Artificial Sequence; identical to SEQ ID NO: 124685
  derived and/or modified sequence opt3 from hemagglutinin__InfluenzaA__ADO12293

SEQ ID NO: 128095 - RNA, 1701 nt, Artificial Sequence; identical to SEQ ID NO: 124685
  derived and/or modified sequence opt3 from hemagglutinin__InfluenzaA__ADO12303

SEQ ID NO: 128096 - RNA, 1701 nt, Artificial Sequence; identical to SEQ ID NO: 124685
  derived and/or modified sequence opt3 from hemagglutinin__InfluenzaA__ADO12313

SEQ ID NO: 128097 - RNA, 1701 nt, Artificial Sequence; identical to SEQ ID NO: 124685
  derived and/or modified sequence opt3 from hemagglutinin__InfluenzaA__ADO12323

SEQ ID NO: 128098 - RNA, 1701 nt, Artificial Sequence; identical to SEQ ID NO: 124685
  derived and/or modified sequence opt3 from hemagglutinin__InfluenzaA__ADO12333

SEQ ID NO: 128099 - RNA, 1701 nt, Artificial Sequence; identical to SEQ ID NO: 124685
  derived and/or modified sequence opt3 from hemagglutinin__InfluenzaA__ADO12343

SEQ ID NO: 128100 - RNA, 1701 nt, Artificial Sequence; identical to SEQ ID NO: 124685
  derived and/or modified sequence opt3 from hemagglutinin__InfluenzaA__ADO12353

SEQ ID NO: 128101 - RNA, 1701 nt, Artificial Sequence; identical to SEQ ID NO: 124685
  derived and/or modified sequence opt3 from hemagglutinin__InfluenzaA__ADO12363

SEQ ID NO: 128102 - RNA, 1701 nt, Artificial Sequence
  derived and/or modified sequence opt3 from hemagglutinin__InfluenzaA__ADO12373
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaauaacaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128103 - RNA, 1701 nt, Artificial Sequence; identical to SEQ ID NO: 126170
  derived and/or modified sequence opt3 from hemagglutinin__InfluenzaA__ADO12383

SEQ ID NO: 128104 - RNA, 1701 nt, Artificial Sequence
  derived and/or modified sequence opt3 from hemagglutinin__InfluenzaA__ADO12403
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauguacacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 128105 - RNA, 1701 nt, Artificial Sequence; identical to SEQ ID NO: 126321
  derived and/or modified sequence opt3 from hemagglutinin__InfluenzaA__ADO12413

SEQ ID NO: 128106 - RNA, 1701 nt, Artificial Sequence; identical to SEQ ID NO: 124685
  derived and/or modified sequence opt3 from hemagglutinin__InfluenzaA__ADO12423

SEQ ID NO: 128107 - RNA, 1701 nt, Artificial Sequence; identical to SEQ ID NO: 124685
  derived and/or modified sequence opt3 from hemagglutinin__InfluenzaA__ADO12433

SEQ ID NO: 128108 - RNA, 1701 nt, Artificial Sequence; identical to SEQ ID NO: 124685
  derived and/or modified sequence opt3 from hemagglutinin__InfluenzaA__ADO12443

SEQ ID NO: 128109 - RNA, 1701 nt, Artificial Sequence; identical to SEQ ID NO: 124685
  derived and/or modified sequence opt3 from hemagglutinin__InfluenzaA__ADO12453

SEQ ID NO: 128110 - RNA, 1701 nt, Artificial Sequence; identical to SEQ ID NO: 124685
  derived and/or modified sequence opt3 from hemagglutinin__InfluenzaA__ADO12463

SEQ ID NO: 128111 - RNA, 1701 nt, Artificial Sequence
  derived and/or modified sequence opt3 from hemagglutinin__InfluenzaA__ADO12473
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcagaaugggaaacuauguaagcucagaggaguggcuccccugcaccuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcaacugagcaguguguccucuuucgaacgguuugagauuuucccgaagacaagcuccuggcccaaucaugauucaaacaagggugucaccgccgcuuguccucacgcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucagcagaguuuguaccagaacgccgacgcguacguguucgucgggacuucucgcuauuccaagaaauuuaagccugagauugcaauccgaccaaaagugcgugaucaagagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcacgacugcaauacaaccugucagacgccgaaaggcgcuaucaacacuucucuccccuuccagaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaucaaaaugaacagggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucacgauagcaauguaaagaaccuguacgagaagguucgaucacaacucaaaaacaaugcaaaggaaaucggcaacggauguuuugaguucuaucauaagugcgacaauacauguauggaaagugugaaaaacggcacuuacgauuauccuaaguacuccgaggaagccaaacugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 128112 - RNA, 1701 nt, Artificial Sequence; identical to SEQ ID NO: 124685
  derived and/or modified sequence opt3 from hemagglutinin__InfluenzaA__ADO12493

SEQ ID NO: 128113 - RNA, 1701 nt, Artificial Sequence
  derived and/or modified sequence opt3 from hemagglutinin__InfluenzaA__ADO12503
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucaacuuuuggaugugcuccaaugguucuuuacagugccggauuuguaucuga

SEQ ID NO: 128114 - RNA, 1701 nt, Artificial Sequence
  derived and/or modified sequence opt3 from hemagglutinin__InfluenzaA__ADO12513
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagagagguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggaaagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 128115 - RNA, 1701 nt, Artificial Sequence; identical to SEQ ID NO: 124685
  derived and/or modified sequence opt3 from hemagglutinin__InfluenzaA__ADO12523

SEQ ID NO: 128116 - RNA, 1701 nt, Artificial Sequence
  derived and/or modified sequence opt3 from hemagglutinin__InfluenzaA__ADO12533
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccacccgccugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 128117 - RNA, 1701 nt, Artificial Sequence; identical to SEQ ID NO: 124685
  derived and/or modified sequence opt3 from hemagglutinin__InfluenzaA__ADO12543

SEQ ID NO: 128118 - RNA, 1701 nt, Artificial Sequence; identical to SEQ ID NO: 124685
  derived and/or modified sequence opt3 from hemagglutinin__InfluenzaA__ADO12553

SEQ ID NO: 128119 - RNA, 1701 nt, Artificial Sequence; identical to SEQ ID NO: 124685
  derived and/or modified sequence opt3 from hemagglutinin__InfluenzaA__ADO12563

SEQ ID NO: 128120 - RNA, 1701 nt, Artificial Sequence; identical to SEQ ID NO: 124685
  derived and/or modified sequence opt3 from hemagglutinin__InfluenzaA__ADO12573

SEQ ID NO: 128121 - RNA, 1701 nt, Artificial Sequence
  derived and/or modified sequence opt3 from hemagglutinin__InfluenzaA__ADO12593
augaaggccauccuggugguccuccuuuacaccuucgcuacagcaaacgccgacacucugugcauuggcuaucacgcgaauaacagcacggauauaguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 128122 - RNA, 1701 nt, Artificial Sequence; identical to SEQ ID NO: 124685
  derived and/or modified sequence opt3 from hemagglutinin__InfluenzaA__ADO12603

SEQ ID NO: 128123 - RNA, 1701 nt, Artificial Sequence; identical to SEQ ID NO: 124685
  derived and/or modified sequence opt3 from hemagglutinin__InfluenzaA__ADO12613

SEQ ID NO: 128124 - RNA, 1701 nt, Artificial Sequence; identical to SEQ ID NO: 124685
  derived and/or modified sequence opt3 from hemagglutinin__InfluenzaA__ADO12623

SEQ ID NO: 128125 - RNA, 1701 nt, Artificial Sequence
  derived and/or modified sequence opt3 from hemagglutinin__InfluenzaA__ADO14349
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaagggaagcuauguaaacucagaggaguggcuccccugcaucuugguaagugcaauauagccggcuggauccuggggaacccugagugugaaucuuugucaacagcaaguagcugguccuacauuguugagaccucuucgucagacaagggaacuugcuauccaggcgauuuuaucgacuacgaggagcucagggagcagcugagcaguguguccucuuucgaacgguuugagauuuucccgaaaacaagcuccuggcccaaucacgauucaaacaagggugucaccgccgcuuguccucaugcaggggccaaaaguuuuuauaagaaucugaucuggcucgugaaaaagggaaacagcuacccaaaguuaucuaaauccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaacacuucucuccccuuccagaauauucacccuaucacaaucgguaaaugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaagaugaauacccaguuuacagcuguugguaaagaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaagaauaacgcaaaagaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 128126 - RNA, 1701 nt, Artificial Sequence; identical to SEQ ID NO: 126949
  derived and/or modified sequence opt3 from hemagglutinin__InfluenzaA__ADO14351

SEQ ID NO: 128127 - RNA, 1701 nt, Artificial Sequence
  derived and/or modified sequence opt3 from hemagglutinin__InfluenzaA__ADO14353
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcagaagccaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacauucccucaauacagaguaggggguuguuuggagcgaucgccggcuucauugaaggcggguggacaggaaugguggacgguugguacggcuaucaucaccagaaugagcaagggagcggauacgcagcugaucucaaauccacccagaacgccaucgacgagauaacgaauaaggucaacucugugauugaaaagaugaauacccaguuuacagcuguuggcaaggaguucaaccaccuggaaaagcggaucgagaauuuaaacaaaaagguggaugacgguuuccuggauaucuggacuuacaaugccgaacuccuuguccuguuggagaacgagcgcacccuagacuaucaugauagcaaugugaaaaaccuguacgaaaagguacgaucacagcucaaaaacaaugcaaaggagauugggaacggcuguuuugaguucuaucacaagugcgacaauacauguauggagaguguuaaaaacggaacuuacgauuauccuaaguacuccgaagaggccaaacugaauagagaggaaaucgacggcgugaaacuugagagcaccaggauuuaucaaauacuggcuaucuacucuacagucgcgucaaguuuggugcucgucgugagccugggggcaauuuccuuuuggaugugcucuaacggaucguuacagugccggaucuguaucuga

SEQ ID NO: 128128 - RNA, 1701 nt, Artificial Sequence
  derived and/or modified sequence opt3 from hemagglutinin__InfluenzaA__ADO14354
augaaggccauccuggugguccuccuuuacaccuucgcuacagcaaacgccgacacucugugcaugggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauugccggcuggauacuggggaauccugagugugaaucuuugucaacagcaaguagcugguccuacaucguugagaccucuucgucagacaacggaacuugcuauccaggcgauuuuauugacuacgaagaacucagggagcagcugagcaguguguccucuuucgaacgguuugagaucuucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugagcaggaaggaagaaugaauuacuauuggacccugguggagcccggugauaagaucacauucgaagccacuggcaaccuagucguuccuagguacgcuuuugccauggagcggaacgcagggagcggaauuaucauaucggacaccccagugcaugauugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugagcaaggaagcggcuacgcagcugaccucaaauccacccagaacgccaucgaugagauuacgaauaaggugaacucuguuaucgaaaagaugaauacccaguuuacagcuguggguaaggaguucaaccaccuggaaaagcggauagagaauuuaaacaaaaaggucgacgauggguuccuggacauuuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaaucgauggggucaaacuugagagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 128129 - RNA, 1701 nt, Artificial Sequence
  derived and/or modified sequence opt3 from hemagglutinin__InfluenzaA__ADO14356
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacauucccucaauacagaguaggggcuuguuuggcgcgaucgccggguucauugagggagguuggacaggcaugguggacgggugguacggauaucaucaccagaaugaacaaggcagcgguuacgcagcugaccucaaauccacccagaacgccaucgaugagauaacgaauaaggucaacucugugauugagaaaaugaauacccaguuuacagcuguugggaaggaguucaaccaccuggagaagcggaucgaaaauuuaaacaaaaagguggacgauggcuuccuggacaucuggacuuacaaugccgagcuccuuguccuguuggaaaacgagcgcacccuagauuaucaugacagcaaugugaaaaaccuguacgagaagguacgaucacagcucaaaaacaaugcaaaggaaauuggaaacggcuguuuugaguucuaucacaagugcgauaauacauguauggaaaguguuaaaaacgggacuuacgacuauccugaguacuccgaagaggccaagcugaauagagaggaaaucgauggagugaaacuugagagcaccaggauuuaucaaauacuggcuaucuacucuacagucgcgucaaguuuggugcucgucgugagccugggugcaauuuccuuuuggaugugcucuaacggcucguuacagugccggaucuguaucuga

SEQ ID NO: 128130 - RNA, 1701 nt, Artificial Sequence; identical to SEQ ID NO: 126949
  derived and/or modified sequence opt3 from hemagglutinin__InfluenzaA__ADO14357

SEQ ID NO: 128131 - RNA, 1701 nt, Artificial Sequence
  derived and/or modified sequence opt3 from hemagglutinin__InfluenzaA__ADO14359
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaucccccuacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcacgacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggaaucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 128132 - RNA, 1701 nt, Artificial Sequence
  derived and/or modified sequence opt3 from hemagglutinin__InfluenzaA__ADO14361
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaagggaacuugcuauccaggcgauuuuaucgacuacgaggagcucagggagcagcugagcaguguguccucuuucgaacgguuugagauuuucccgaagacaagcuccuggcccaaccacgauucaaauaaaggugucaccgccgcuuguccucaugcaggggccaagaguuuuuauaaaaaccugaucuggcucgugaagaaaggaaauagcuacccaaaguuaucuaaguccuauauaaacgacaaaggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaucuagucguuccuagguacgcuuuugccauggaacggaacgcagggagcggaaucauaauuucggauaccccagugcaugacugcaacacaaccugucaaacgccgaagggcgcuaucaauacuucucuccccuuccagaacauucacccuaucacaaucgguaagugcccaaaauauguaaaguccaccaaacugcgccuugccacugggcugagaaauauucccucaauacagaguaggggauuguuuggcgcgaucgccggcuucauugaagggggauggacagguaugguggacggcugguacggguaucaucaccagaacgaacaaggaagcggcuacgcagcugaucucaaguccacccagaaugccaucgacgagauaacgaacaaagucaauucugugauugagaagaugaacacccaguuuacagcuguugguaaggaguucaaucaccuggaaaaacggaucgaaaacuuaaauaagaaaguggaugacggguuccuggauaucuggacuuacaacgccgagcuccuuguccuguuggaaaaugagcgcacccuagacuaucaugauagcaacgugaagaaucuguacgagaaaguacgaucacagcucaagaacaacgcaaaggaaauuggcaauggauguuuugaguucuaucacaaaugcgacaacacauguauggaaaguguuaagaauggcacuuacgauuauccuaaauacuccgaggaagccaagcugaacagagaggagaucgacggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 128133 - RNA, 1701 nt, Artificial Sequence
  derived and/or modified sequence opt3 from hemagglutinin__InfluenzaA__ADO14362
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaaacagcgcugaucaacagaguuuguaccagaaugccgacgcguacguguucgucgggacgucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 128134 - RNA, 1683 nt, Artificial Sequence
  derived and/or modified sequence opt3 from hemagglutinin__InfluenzaA__ADO21015
auggagguggucagccugaucaccauucuccuucugguuacaguguccaacgccgacaagauaugcaucggcuaccaaucuacuaauucaacggaaaccguagauacauugacugagaacaaugugcccgucgcucacgcaaaagaauuacugcauaccgagcacaacgggaugcuaugugccacaaaucucggacauccucugauucuugauaccugcacuaucgaaggucugauuuauggcaacccaaguugugacuugcuccucgggggaagagaguggagcuacaucguggagaggccguccgcgguuaauggccugugcuaucccgguaacguggaaaaucuggaggaauuacggucucuguucucgucagcuagcaguuaccaacgcauacagaucuuuccugggacaauuuggaacgucuccuauggaggcaccucuaaggccuguagcgacuccuucuacaaaucaaugcgauggcuuacgcagaagaauaacgcauauccaauccaggaugcccaauacacuaauaaccguggcaaaaauauuuuguuuaugugggggaucaaccaucccccuaccgacacaacucagaccaaccuguacacaagaaccgauacgacuacaaguguggcuaccgaggacauaaauaggacuuucaagccacuaauuggaccccggccucucguaaacggucagcagggccgcaucgauuauuacuggagcguucugaagccagggcaaacacuuagagugaggucuaauggaaaccugauugcaccgugguauggccacaucuuguccggugagucacacgggcggauccucaaaaccgaccugaauagcggaaacugcgucgugcagugucagacggaacgcggcggcuuaaauaccacacugcccuuucacaacgugaguaaguacgccuucgggaauugcccuaaauaugucggaguuaagucucucaaacuugcugugggucugcgaaacguaccagccagauccagcaggggcuuguuuggggcgauugcaggauucauagagggcgguuggucggggcuaguggccggcugguacggauuucagcauucuaaugaucaaggcgucgggauggcugccgaccgggauuccacucagaaggcaaucgacaagauuaccucaaaagugaacaauaucguugacaagaugaacaaacaguaugaaauaauugaucacgaguucagugaaguggagacacgucugaauaugaucaacaacaagaucgacgaucaaauucaggacaucugggcuuacaaugccgagcuccugguccuucuggaaaaccagaaaacuuuggaugagcaugacgcgaaugugaacaaucucuacaacaagguaaaacgcgcccugggaagcaaugcaguugaagaugguaagggcuguuuugaguuauaucacaagugcgacgaucaguguauggaaaccauuagaaacgggacauacaauaggcggaaauauaaggaggagucccgacuggaacgccagaaaauagagggagugaagcuagaaucugagggcaccuacaaaauccucacuauuuauagcacggucgcuucaagucuggugaucgccauggguuucgcugccuuucuuuucugggcaauguccaacgggagcugcagaugcaauaucuguauuuga

SEQ ID NO: 128135 - RNA, 1683 nt, Artificial Sequence
  derived and/or modified sequence opt3 from hemagglutinin__InfluenzaA__ADO21026
auggagguggucagccugaucaccauucuccuucugguuacaguguccaacgccgacaagauaugcaucggcuaccagucuacuaauucaacggaaaccguagauacauugacugagaacaaugugcccgucgcucacgcaaaagaauuacugcauaccgagcacaacgggaugcuaugugccacaaaucucggacauccucugauucuugauaccugcacuaucgaaggucugauuuauggcaacccaaguugugacuugcuccuugggggaagagaguggagcuacaucguggagaggccguccgcgguuaauggccugugcuaucccgguaacguggaaaaucucgaggaauuacggucucuguucucgucagcuagcaguuaccaacgcauacagaucuuuccugggacaauuuggaacgucuccuauggaggcaccucuaaggccuguagcgacuccuucuacaaaucaaugcgauggcuuacgcagaagaauaacgcauauccaauccaggaugcccaauacacuaauaaccguggcaaaaauauuuuguuuaugugggggaucaaccaucccccuaccgacacaacucagaccaaccuguacacaagaaccgauacgacuacaaguguggcuaccgaggacauaaauaggacuuucaacccacuaauuggaccccggccucucguaaauggucagcagggccgcaucgauuauuacuggagcguucugaagccagggcaaacacuuagagugaggucuaacggaaaucugauugcaccgugguauggccacaucuuguccggugagucacacgggcggauccucaagaccgaccugaacagcggaaauugcgucgugcagugucagacggaacgcggcggcuuaaacaccacacugcccuuucacaaugugaguaaauacgccuucgggaacugcccuaaguaugucggaguuaaaucucucaagcuggcugugggucugcgaaauguaccagccagauccagcaggggcuuguuuggggcgauugcaggauucauagagggcgguuggucggggcuaguggccggcugguacggauuucagcauucuaacgaucaaggcgucgggauggcugccgaccgggauuccacucagaaagcaaucgacaagauuaccucaaaggugaauaacaucguugacaaaaugaauaagcaguaugaaauaauugaucacgaguucagugaaguggagacacgucugaacaucaucaacaauaaaauugacgaucaaauccaggacauuugggcuuacaacgccgagcuccugguccuucuggaaaaucagaagacuuuggaugagcaugacgcgaacgugaauaaccucuacaauaaaguaaagcgcgcccugggaagcaacgcaguugaagaugguaaaggcuguuuugaguuauaucacaagugcgacgaucaguguauggaaaccauaagaaaugggacauacaacaggcggaaguauaaagaggagucccgacuggaacgccaaaagaucgagggagugaaacuagaaucugagggcaccuacaagauucucacuaucuauagcacggucgcuucaagucuggugaucgccauggguuucgcugccuuucuuuucugggcaauguccaaugggagcugcagaugcaacauuuguauauga

SEQ ID NO: 128136 - RNA, 1683 nt, Artificial Sequence
  derived and/or modified sequence opt3 from hemagglutinin__InfluenzaA__ADO21037
auggagguggucagccugaucaccauucuccuucugguuacaguguccaacgccgacaagauaugcaucggcuaccaaucuacuaauucaacggaaaccguagauacauugacugagaacaaugugcccgucgcucacgcaaaagaauuacugcauaccgagcacaacgggaugcuaugugccacaaaucucggacauccucugauucuugauaccugcacuaucgaaggucugauuuauggcaacccaaguugugacuugcuccucgggggaagagaguggagcuacaucguggagaggccguccgcgguuaauggccugugcuaucccgguaacguggaaaaucuggaggaauuacggucucuguucucgucagcuagcaguuaccaacgcauacagaucuuuccugggacaauuuggaacgucuccuauggaggcaccucuaaggccuguagcgacuccuucuacaaaucaaugcgauggcuuacgcagaagaauaacgcauauccaauccaggaugcccaauacacuaauaaccguggcaaaaauauuuuguuuaugugggggaucaaccaucccccuaccgacacaacucagaccaaccuguacacaagaaccgauacgacuacaaguguggcuaccgaggacauaaauaggacuuucaagccauauauuggaccccggccucuaguaaacggucagcagggccgcaucgauuacuauuggagcguucucaagccagggcaaacacugagagugaggucuaauggaaaccuuauugcaccgugguacggccacauccuguccggugagucacacgggcggaucuugaaaaccgaccucaauagcggaaacugcgucgugcagugucagacggaacgcggcggccugaauaccacauuacccuuucacaacgugaguaaguaugccuucgggaauugcccuaaauacgucggaguuaagucucugaaacucgcugugggucuucgaaacguaccagccagauccagcaggggccuguuuggggcgauugcaggauucauagagggcgguuggucgggguugguggccggcugguauggauuucagcauucuaaugaucaaggcgucgggauggcugccgaccgggaucuaacucagaaggcaaucgacaagauuaccuccaaagugaacaauaucguugacaagaugaacaaacaguacgaaauaauugaucacgaguucucagaaguggagacacgucugaauaugaucaacaacaagaucgacgaucaaauucaggacaucugggcuuacaaugccgagcuccugguccuucuggaaaaccagaaaacuuuggaugagcaugacgcgaaugugaacaaucucuauaacaagguaaaacgcgcccugggaaguaaugcaguugaagaugguaagggcuguuuugaguuauaccacaagugcgacgaucaguguauggaaaccauuagaaacgggacauauaauaggcggaaauacaaggaggagagccgacuggaacgccagaaaauagagggagugaagcuagaauccgagggcaccuauaaaauccucacuauuuacucuacggucgcuagcucacuggugaucgccauggguuucgcugccuuucuuuucugggcaaugaguaacggguccugcagaugcaauaucuguauuuga

SEQ ID NO: 128137 - RNA, 1683 nt, Artificial Sequence
  derived and/or modified sequence opt3 from hemagglutinin__InfluenzaA__ADO21048
auggagguggucagccugaucaccauucuccuucugguuacaguguccaacgccgacaagauaugcaucggcuaccaaucuacuaauucaacggaaaccguagauacauugacugagaacaaugugcccgucgcucacgcaaaagaauuacugcauaccgagcacaacgggaugcuaugugccacaaaucucggacauccucugauucuugauaccugcacuaucgaaggucugauuuauggcaacccaaguugugacuugcuccucgggggaagagaguggagcuacaucguggagaggccguccgcgguuaauggccugugcuaucccgguaacguggaaaaucuggaggaauuacggucucuguucucgucagcuagcaguuaccaacgcauacagaucuuuccugggacaauuuggaacgucuccuauggaggcaccucuaaggccuguagcgacuccuucuacaaaucaaugcgauggcuuacgcagaagaauaacgcauauccaauccaggaugcccaauacacuaauaaccguggcaaaaauauucacuuuaugugggggaucaaccaucccccuaccgacacaacucagaccaacuuguacacaagaaccgauacgacuacaaguguggcuaccgaggacauaaauaggacuuucaagccacugauuggaccccggccucuaguaaacggucagcagggccgcaucgauuauuacuggagcguucucaagccagggcaaacacugagagugaggucuaauggaaaccuuauugcaccgugguauggccacauccuguccggugagucacacgggcggaucuugaaaaccgaccucaauagcggaaacugcgucgugcagugucagacggaacgcggcggccugaauaccacauuacccuuucauaacgugaguaaguacgccuucgggaauugcccuaaauaugucggaguuaagucucugaaacucgcugugggucuucgaaacguaccagccagauccagcaggggccuguuuggggcgauugcaggauucauagagggcgguuggucgggguugguggccggcugguacggauuucagcacucuaaugaucaaggcgucgggauggcugccgaccggguguccacucagaaggcaaucgauaagauuaccucaaaaguuaacaauaucguggacaagaugaacaaacaguaugaaauaauugaccaugaguucagugaagucgagacacgucuaaauaugaucaacaacaagaucgaugaccaaauucaggauaucugggcuuacaaugccgagcugcucgugcugcuugaaaaccagaaaacucuggacgagcacgaugcgaauguaaacaauuuguacaacaagguuaaacgcgcccucggaagcaaugcaguggaagacgguaagggcuguuuugagcuguaucacaagugcgaugaccaguguauggaaaccauuagaaacgggacauacaauaggcggaaauauaaggaggagucccgauuagaacgccagaaaauagagggagucaagcuggaaucugagggcaccuacaaaauccuaacuauuuauagcacgguggcuucaagucucgucaucgccauggguuucgcugccuuucuguucugggcaauguccaacgggagcugcagaugcaauaucuguauuuga

SEQ ID NO: 128138 - RNA, 1701 nt, Artificial Sequence
  derived and/or modified sequence opt3 from hemagglutinin__InfluenzaA__ADO25092
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaauuccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagcucaugacugcaacacaaccugucaaacgccgaagggcgccaucaauacuucucuccccuuccagaacauucacccuaucacaaucgguaaaugcccaaaguaugugaaguccaccaaacugcgccuugcgacugggcugagaaauguacccucaauucagaguaggggauuguuuggcgccauagcaggcuucaucgaagggggauggacagguaugguggacggcugguacggguaucaucaccagaacgaacaaggaagcggcuacgcugccgaucucaaguccacccagaaugcuauugacgagaucacgaacaaagucaauucugugauagagaagaugaacacccaguuuacagccguugguaaagaguucaaucaccuggaaaagcggauugaaaacuuaaauaagaaaguggaugacggguuccuggauaucuggacuuacaacgcagagcuccuuguccuguuggaaaaugagcgcacccuagacuaucaugauagcaacgugaagaaccuguacgagaaaguacgaucacagcucaagaauaacgccaaagaaaucggcaauggauguuuugaguucuaucacaagugcgacaacacauguauggaaaguguuaagaauggcacuuacgauuauccuaaauacuccgaggaagcuaagcugaacagagaggagauugacggggugaaacuugaaagcaccaggaucuaucaaauucuggcgauauacucuacagucgcaucaaguuuggugcucgucgugagccugggagccaucuccuuuuggaugugcucuaaugguucguuacagugccggauuuguaucuga

SEQ ID NO: 128139 - RNA, 1701 nt, Artificial Sequence; identical to SEQ ID NO: 126557
  derived and/or modified sequence opt3 from hemagglutinin__InfluenzaA__ADO25112

SEQ ID NO: 128140 - RNA, 1701 nt, Artificial Sequence; identical to SEQ ID NO: 126557
  derived and/or modified sequence opt3 from hemagglutinin__InfluenzaA__ADO25122

SEQ ID NO: 128141 - RNA, 1701 nt, Artificial Sequence
  derived and/or modified sequence opt3 from hemagglutinin__InfluenzaA__ADO25132
augaacgccauccuggugguccuccuuuacaccuucgcuacagcaaaugccgacacucugugcauuggcuaucacgcgaacaauagcacggauaccguugacacauuguuagagaagaacgugacuguaacccauuccgugaaucugcuagaagauaaacacaacgggaagcucuguaaacugagaggagucgcuccccuucaucuggguaagugcaauauagccggcuggaucuuggggaacccugagugugaaucucucucaacagcaaguagcugguccuacauuguggagaccucuucgucagacaauggaacuugcuauccaggcgauuuuaucgacuacgaagaacugagggagcagcugagcaguguuuccucuuucgaacgguuugagauuuucccgaaaacaagcuccuggcccaaccacgauucaaauaagggugugaccgccgcuuguccucaugcaggggccaagaguuuuuauaaaaaccucaucugguuagucaagaaaggaaauagcuacccaaagcugucuaaauccuauauaaacgacaagggcaaggaagugcuuguauuguggggcauccaccaccccucaacgagcgcugaucaacagagucuguaccagaaugccgacgcguacguuuucguggggacuucucgcuauuccaaaaaguuuaaaccugagauugcaauccgaccaaagguccgugaucaggagggaagaaugaacuacuauuggacccuaguggaacccggugacaaaauuacauucgaggccacuggcaaccucguggucccuagguacgcuuuugccauggaacggaaugcagggagcgauaucauaauuucggacaccccaguucaugacugcaacacaaccugucaaacgccgaagggagcuaucaauacuucucugcccuuccagaacauucacccuaucacaaucggcaaaugcccaaaguaugugaaguccaccaaacuucgccuggccacugguuugagaaauguacccucaauucagaguagggggcucuuuggagcgauagccggcuucaucgagggcggguggacaggaaugguggaugguugguacggcuaucaucaccagaacgaacaagggagcggauacgcagcugaccugaaguccacccagaaugccauugaugagaucacgaacaaaauaaauucugucauugagaagaugaacacccaguuuacagcugugggcaaagaguucaaucacuuagagaagcggaucgaaaaccugaauaagaaaguugacgaugguuuccucgacaucuggacuuacaacgccgagcuucugguguugcuagaaaaugagcgcacccuggauuaucaugacagcaacgucaagaaccucuacgagaaagugcgaucacagcugaagaauaacgcaaaagaaauugggaauggcuguuuugaguucuaucacaagugcgauaacacauguauggaaaguguaaagaauggaacuuacgacuauccuaaauacuccgaggaagccaaacuuaacagagaggagaucgauggcguuaagcuggaaagcaccaggauuuaucaaauauuggcuaucuacucuacaguggcgucaagucucguccugguggucagcuuaggggcaauuuccuuuuggaugugcucuaauggaucgcugcagugccggaucuguaucuga

SEQ ID NO: 128142 - RNA, 1701 nt, Artificial Sequence; identical to SEQ ID NO: 126298
  derived and/or modified sequence opt3 from hemagglutinin__InfluenzaA__ADO25142

SEQ ID NO: 128143 - RNA, 1701 nt, Artificial Sequence
  derived and/or modified sequence opt3 from hemagglutinin__InfluenzaA__ADO25152
augaaggccauccuggugguccuccuuuacaccuucgcugcagccaacgcggacacacugugcauuggcuaucacgcuaauaacagcacugauacgguugacaccguguuggagaaaaauguaacagugacucauuccgucaacuuacuggaagauaagcacaaugggaaacuauguaagcucagaggaguggcaccccugcaucuugguaaaugcaacauagccggcuggauccuggggaauccugagugugaaucuuugucaaccgccaguagcugguccuacauuguugagacaucuucgucagacaacggaaccugcuauccaggcgauuuuaucaauuacgaggagcucagggagcagcugagcagugugucccuguucgaacgguuugagauuuucccgaagacuucuagcuggcccaaccacgacuccaauaagggugucacagcugcauguccucaugccggggcuaaaucauuuuauaagaaccucaucugguuagugaaaaagggaaauaguuacccaaaacugagcaagucuuauauaaacgauaagggcaaagaaguacuuguuuuguggggcauccaccaccccuccaccucagccgaccaacagagccuguaccagaaugcggaugcauacguguucgucgggacgagucgcuauucuaagaaauuuaagccugagauugccauccgaccaaaagugcgugaccaggagggaagaaugaacuacuauuggacucuaguggaacccggugauaagauuaccuucgaggcuacaggcaaccucgucguuccuagguacgccuuugcaauggaacggaaugcuggguccggaaucauaauuagcgacacuccagugcaugauugcaacaccacaugucaaaccccgaaaggcgccaucaauacgucgcugcccuuccagaacauucacccuaucacuaucgguaagugcccaaaguauguaaaaucuacaaagcugcgccuugcgaccggguugagaaaugugcccuccauucagucaaggggacucuuuggcgccauagcaggcuucaucgaagggggauggacugguauggucgacggcugguacggguaucaucaccagaacgaacaaggaaguggcuacgcugccgaccugaaaagcacacagaaugcuauugauaagaucaccaacaaaguuaauuccgugauagagaagaugaacacgcaguuuaccgccguggguaaggaguucaaucacuuagaaaaacggauugagaaccugaauaagaaagucgacgauggguuccucgacaucuggacauacaacgcagaacuucugguguugcuagagaaugaacgcacucuggauuaucaugacucuaacguaaagaaccucuacgagaaaguucgaagccagcugaagaauaacgccaaggagaucggcaauggauguuuugaguucuaucacaaaugcgauaacaccuguauggaaucagugaagaauggcacauacgacuauccuaaauacagugaagaggcuaaacuuaacagagaagagauugauggggucaagcuggaguccacuaggaucuaucaaauuuuggcgauauacagcaccguggcaucuucacucguccuggugguuaguuuaggagccaucagcuuuuggaugugcuccaaugguucucugcagugccggauuuguaucuga

SEQ ID NO: 128144 - RNA, 1701 nt, Artificial Sequence; identical to SEQ ID NO: 126237
  derived and/or modified sequence opt3 from hemagglutinin__InfluenzaA__ADO25162

SEQ ID NO: 128145 - RNA, 1701 nt, Artificial Sequence; identical to SEQ ID NO: 126237
  derived and/or modified sequence opt3 from hemagglutinin__InfluenzaA__ADO25172

SEQ ID NO: 128146 - RNA, 1701 nt, Artificial Sequence; identical to SEQ ID NO: 126237
  derived and/or modified sequence opt3 from hemagglutinin__InfluenzaA__ADO25182

SEQ ID NO: 128147 - RNA, 1701 nt, Artificial Sequence; identical to SEQ ID NO: 124685
  derived and/or modified sequence opt3 from hemagglutinin__InfluenzaA__ADO25192

SEQ ID NO: 128148 - RNA, 1701 nt, Artificial Sequence; identical to SEQ ID NO: 124685
  derived and/or modified sequence opt3 from hemagglutinin__InfluenzaA__ADO25202

SEQ ID NO: 128149 - RNA, 1701 nt, Artificial Sequence
  derived and/or modified sequence opt3 from hemagglutinin__InfluenzaA__ADO25212
augaaggccauccuggugguccuccuuuacaccuucgcuacagcaaacgccgacacucugugcauuggauaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagcgcaaagaaguacugguucuuuggggcauccaccaccccucaacgagcgcugaucaacagaguuuguaccagaacgccgacucuuacguguucgucggcacuucccgauauagcaagaaauuuaagccugagauugcgauccguccaaaagugagagaucaggaggggaggaugaauuacuauuggacccugguggaacccggagacaagauuacauucgaggcaacugguaaccuagucguuccucgguacgccuuugcuauggaacgcaacgccggcucggggaucauaauuucugauaccccagugcaugacugcaauacaaccugucaaacgccggagggagcaaucaacacuucccuccccuuccagaauauucacccuaucacaaucggcaaaugcccaaaguauguaaagucaaccaaacugagacuugcuacuggucugaggaacgugcccaguauucagagccggggguuguuuggagccauagcgggcuucaucgaaggcggguggacaggaauggucgacgguugguacggcuaucaucaccagaaugagcaaggguccggauacgccgcagaucucaagucuacccagaacgcuauugacgagaucacgaauaaagugaacagcguuauagaaaagaugaauacccaguuuacagccgugggcaaagaguucaaccaccuggaaaagcgcauugagaauuuaaacaagaaagucgaugacgguuuccuggauaucuggacuuacaaugcugaacuccuugugcuguuggagaacgagcgaacccuagacuaucaugauucaaauguaaagaaccuguacgaaaaaguuagaagucagcucaagaacaaugccaaagagaucgggaacggcuguuuugaguucuaucacaagugcgacaauacauguauggaguccgugaagaacggaacuuacgauuauccuaaauacagcgaagaggcaaagcugaauagggaggaaauugacggcgucaaacuugagucuacccggaucuaucaaauucuggccauauacucaacaguggcuaguagcuugguccucgugguuucccugggggcgaucucuuuuuggaugugcucgaacggcagcuuacagugccguauuuguaucuga

SEQ ID NO: 128150 - RNA, 1701 nt, Artificial Sequence
  derived and/or modified sequence opt3 from hemagglutinin__InfluenzaA__ADO25222
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucuaacguaaagaaccuguacgagaaaguucgaagccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 128151 - RNA, 1701 nt, Artificial Sequence; identical to SEQ ID NO: 126298
  derived and/or modified sequence opt3 from hemagglutinin__InfluenzaA__ADO25232

SEQ ID NO: 128152 - RNA, 1701 nt, Artificial Sequence; identical to SEQ ID NO: 126237
  derived and/or modified sequence opt3 from hemagglutinin__InfluenzaA__ADO25242

SEQ ID NO: 128153 - RNA, 1701 nt, Artificial Sequence; identical to SEQ ID NO: 126315
  derived and/or modified sequence opt3 from hemagglutinin__InfluenzaA__ADO25252

SEQ ID NO: 128154 - RNA, 1701 nt, Artificial Sequence; identical to SEQ ID NO: 126557
  derived and/or modified sequence opt3 from hemagglutinin__InfluenzaA__ADO25262

SEQ ID NO: 128155 - RNA, 1701 nt, Artificial Sequence
  derived and/or modified sequence opt3 from hemagglutinin__InfluenzaA__ADO25272
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggugaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgccgaucaacagaguuuguaccagaacgcugacgccuacgucuucguggggacuucucgcuauuccaagaaauuuaagccugagaucgcgauucgaccaaaagugcgugaucaggagggaagaaugaauuacuauuggacccuggucgaacccggugacaagaucacauucgaggcaacuggcaaccuaguugugccuagguacgccuuugcuauggaacggaacgccgggagcggaauuaucauaucggauaccccaguacaugacugcaauacaaccugucaaacgccgaaaggcgcaauuaacacuucucuccccuuccagaauauccacccuauuacaaucgguaagugcccaaaguaugugaaauccaccaagcugcgccuugcuacugggcugagaaacguccccucaauccagaguaggggauuguuuggcgccauugcgggcuucauagaagggggauggacagguaugguggacggcugguacggguaucaucaccagaaugaacaaggaagcggcuacgccgcagaucucaaauccacccagaacgcuaucgacgagauuacgaauaagguuaacucugugaucgagaaaaugaauacccaguuuacagccgucgguaaggaguucaaccaccuggaaaagcggauagaaaauuuaaacaaaaagguggaugacggguuccuggauauuuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagaucgacggggugaaacuugaaagcaccaggauuuaucaaauccuggccauuuacucuacagucgcuucaaguuuggugcucguugugagccugggagcgauauccuuuuggaugugcucuaacgguucguuacagugccggaucuguauuuga

SEQ ID NO: 128156 - RNA, 1701 nt, Artificial Sequence; identical to SEQ ID NO: 126298
  derived and/or modified sequence opt3 from hemagglutinin__InfluenzaA__ADO25282

SEQ ID NO: 128157 - RNA, 1698 nt, Artificial Sequence; identical to SEQ ID NO: 124504
  derived and/or modified sequence opt3 from hemagglutinin__InfluenzaA__ADO27622

SEQ ID NO: 128158 - RNA, 1701 nt, Artificial Sequence; identical to SEQ ID NO: 124685
  derived and/or modified sequence opt3 from hemagglutinin__InfluenzaA__ADO29887

SEQ ID NO: 128159 - RNA, 1701 nt, Artificial Sequence
  derived and/or modified sequence opt3 from hemagglutinin__InfluenzaA__ADO29888
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguagacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauccuaacaagggugucaccgccgcuuguccacaugcaggggccaagucauuuuauaaaaaucugaucuggcucgugaagaaaggaaacaguuaccccaaguuaagcaaaucuuauauaaaugacaagggcaaggaaguacugguucuuuggggcauccaccacccuuccacgucagcugaucaacagagcuuguaccagaacgccgacgcguacguguucgucgggaccagucgauauucuaaaaaguuuaaaccagagauugcaauccgucccaaggugagagaucaggagggaaggaugaauuacuauuggacucugguggaaccuggugacaaaauuacauucgaggccacuggcaaccuagucguuccacgguacgcuuuugccauggaacgcaacgcaggguccggaaucauaauuagcgauaccccggugcaugacugcaauacaaccugucaaacgcccaagggcgcuaucaacacuucgcucccuuuccagaauauucacccaaucacaaucgguaaaugccccaaguauguaaagucuaccaaacugagacuugccacugggcugaggaacgugccuuccauucagucacggggauuguuuggcgcgauagccggcuucaucgaagggggauggacagguauggucgacggcugguacggguaucaucaccagaaugaacaaggaaguggcuacgcagcugaucucaagagcacccagaacgccauugacgagaucacgaauaaagugaacuccguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauucuaauguaaagaaccuguacgagaaaguuagaagccagcucaagaacaaugcaaaagaaaucggcaacggauguuuugaguucuaucacaagugcgacaauacauguauggaaucagugaagaacggcacuuacgauuauccaaaauacagugaggaagccaagcugaauagggaggagauugacggggucaaacuugaauccacccggaucuaucaaauucuggcuauauacagcacaguggcgucuucauugguccucgugguuagucugggagcaaucagcuuuuggaugugcuccaacgguucuuuacagugccguauuuguaucuga

SEQ ID NO: 128160 - RNA, 1701 nt, Artificial Sequence
  derived and/or modified sequence opt3 from hemagglutinin__InfluenzaA__ADO29889
augaaggccauccuggugguccuccuuuacaccuucgcuacagcaaacgccgacauucugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuuuucaaccaguagcuccuggucuuacaucguugagacaucgucaagcgacaacggaaccugcuauccaggcgauuucauugacuacgaagaguugagggagcagcucaguuccgugucuagcuuugaacgguucgagaucuuuccgaagacuuccucauggcccaaucacgauaguaacaagggugucacagcagccuguccucaugcuggggcaaagagcuucuauaaaaaucugauauggcuggugaaaaagggaaacucuuacccaaaacucuccaagucauauaucaaugacaagggcaaagaaguauuaguucuguggggcauucaccaccccagcaccagugccgaucaacagucucuuuaccagaacgcugacgccuacguguuugucgggacgucccgcuauagcaagaaauucaagccugagaucgcgauucgaccaaaagugcgugaucaggagggaagaaugaauuacuauuggacuuugguggaacccggugacaagaucaccuuugaggcaacaggcaaccuggucguuccuagguacgccuucgcuauggaacggaacgccgggucgggaauaauuaucucugauacuccagugcaugacugcaauaccacaugucaaaccccgaaaggcgcaauuaacacgucccuacccuuucagaauauccacccuaucacuauugguaagugcccaaaguauguaaaaucaacaaagcuccgccuggcuaccgggcuuagaaacgugcccaguauacagagcaggggacuguucggcgccaucgcgggcuuuauugaagggggauggacugguauggucgacggcugguacggguaucaucaccagaaugaacaaggauccggcuacgccgcagauuugaaaucuacacagaacgcuaucgacgagauaaccaauaaggugaacagcguuauugagaaaaugaauacgcaguucaccgccguggguaaggaguucaaccaccucgagaagcggaucgaaaaucugaacaaaaaggucgaugacggguuuuuagauaucuggacauacaaugcugagcugcucgugcuucuggaaaacgagcgcacuuuggacuaucaugauucaaauguuaaaaaccuauacgagaagguacgaagucagcugaaaaacaaugccaaggaaauuggcaacggauguuucgaguuuuaucacaagugcgacaauaccuguauggaauccgugaaaaacggcacauacgauuauccuaaguacagcgaggaagcaaaacucaauagagaggagaucgacggggucaagcuggaaucuacuaggauuuaucaaauacuugccaucuacucaaccguggcuaguagccuggucuuggugguuucccucggagcgauuucuuucuggaugugcucgaacgguagccugcagugccggaucuguaucuga

SEQ ID NO: 128161 - RNA, 1701 nt, Artificial Sequence
  derived and/or modified sequence opt3 from hemagglutinin__InfluenzaA__ADO29890
augaaggccauccuggugguccuccuuuacaccuucgcuacagcaaaagccgacacucugugcauuggcuaucacgcgaacaauagcgcugauacgguugacaccguguuggagaagaacguaacagugacucauuccgucaauuuacuggaagauaaacacaacgggaagcuauguaaacucagaggaguggcaccccugcaucuugguaagugcaauauagccggcuggauccuggggaacccugagugugaaucuuugucaaccgccaguagcugguccuacauuguugagacaucuucgucagacaauggaaccugcuauccaggcgauuuuaucgacuacgaggagcucagggagcagcugagcaguguguccucuuucgaacgguuugagauuuucccgaagacuagcuccuggcccaaccacgauccuaauaaaggugucacagcugcauguccacaugccggggcuaagucauuuuauaaaaaccugaucuggcucgugaagaaaggaaauaguuaccccaaguuaagcaagucuuauauaaacgacaaaggcaaggaaguacugguucuuuggggcauccaccacccuuccaccucaguggaucaacagagcuuguaccagaaugccgacgcguacgucuucguggggacgagucgcuauucuaaaaaguuuaaaccagagauugcaauccgacccaaggugcgugaucaggagggaagaaugaacuacuauuggacucuggucgaaccuggugacaaaauuaccuucgaggccacaggcaaucuaguugugccaagguacgcuuuugccauggaacggaacgcaggguccggaaucauaauuagcgauacuccgguacaugacugcaacaccacaugucaaacccccaagggcgcuaucaauacgucgcucccuuuccagaacauucacccaaucacuaucgguaagugccccaaauaugugaagucuacaaaacugcgccuugccaccgggcugagaaaugucccuuccauucagucaaggggauuguuuggcgcgauagccggcuucaucgaagggggauggacugguaugguggacggcugguacggguaucaucaccagaacgaacaaggaaguggcuacgcagcugaucucaagagcacacagaaugccauugacgagaucaccaacaaaguuaauuccgugauagagaagaugaacacgcaguuuaccgcugucgguaaggaguucaaucaccuggaaaaacggauugaaaacuuaaauaagaaaguggaugacggguuccuggauaucuggacauacaacgccgagcuccuuguacuguuggaaaaugagcgcacucuagacuaucaugauucuaacguuaagaaucuguacgagaaagugcgaagccagcucaagaacaacgcaaaggaaaucggcaauggauguuuugaguucuaucacaaaugcgacaacaccuguauggaaucagucaagaauggcacauacgauuauccaaaauacagugaggaagccaagcugaacagagaggagauugacggggugaaacuugaauccacuaggaucuaucaaauucuggcuauauacagcaccgucgcgucuucauuggugcucguugugagucugggagcaaucagcuuuuggaugugcuccaaugguucuuuacagugccggauuuguaucuga

SEQ ID NO: 128162 - RNA, 1701 nt, Artificial Sequence
  derived and/or modified sequence opt3 from hemagglutinin__InfluenzaA__ADO29891
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagacaacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacaagauuaccaauaaagugaacucuguuaucgagaagaugaauacacaguuuacugcuguggguaaggaguucaaccaccuggaaaaacggauagagaauuuaaacaagaaagucgaugacggguuccuggauauuuggaccuacaaugccgaacuccuugugcugagcgagaacgaacgcacauuggacuaucaugauucaaauguaaagaaccuauacgagaaaguucgaagucagcugaagaacaaugcaaaggagaucggcaacggauguuuugaguucuaucacaaaugcgacaauacuuguauggaauccgugaagaacggcaccuacgauuauccuaaauacagcgaagaggccaagcucaauagagaagagaucgacggggucaaacuggagucuacaaggauuuaucaaauccuugcuauuuacucaaccguggcgaguagccuggucuuggugguuucccucggagcaauaucuuuuuggaugugcucgaacgguagccugcagugccggaucuguauuuga

SEQ ID NO: 128163 - RNA, 1701 nt, Artificial Sequence
  derived and/or modified sequence opt3 from hemagglutinin__InfluenzaA__ADO29892
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcaggauccuggggaacccugagugugaaucuuugucaacagcaaguagcugguccuacauuguugagaccucuucgucagacaauggaacuugcuauccaggcgauuuuaucgacuacgaggagcuccgggagcagcugagcaguguguccucuuucgaacgcuuugagauuuucccgaagacaagcuccuggcccaaccacgauccuaauaaaggugucaccgccgcuuguccacaugcaggggccaagucauuuuauaaaaaccugaucuggcucgugaagaaaggaaauaguuaccccaaguuaagcaagucuuauauaaacgacaaaggcaaggaaguacugguucuuuggggcauccaccacccuuccacgucaguggaucaacagagcuuguaccagaaugcugacgccuacgucuucguggggaccagucgauauucuaaaaaguuuaaaccagagauugcgauccgucccaaggugagagaucaggagggaaggaugaacuacuauuggacucuggucgaaccuggugacaaaauuacauucgaggcaacuggcaaucuaguugugccacgguacgccuuugcuauggaacgcaacgccggguccggaaucauaauuagcgauaccccgguacaugacugcaacacaaccugucaaacgcccaagggcgcaaucaauacuucgcucccuuuccagaacauucacccaaucacaaucgguaagugccccaaauaugugaagucuaccaaacugagacuugcuacugggcugaggaaugucccuuccauucagucacggggauuguuuggcgccauagcgggcuucaucgaagggggauggacagguaugguggacggcugguacggguaucaucaccagaacgaacaaggaaguggcuacgccgcagaucucaagagcacccagaaugcuauugacgagaucacgaacaaaguuaauuccgugauagagaagaugaacacccaguuuacagccgucgguaaggaguucaaucaccuggaaaaacgcauugaaaacuuaaauaagaaaguggaugacggguuccuggauaucuggacuuacaacgcugagcuccuuguacuguuggaaaaugagcgaacccuagacuaucaugauucuaacguuaagaaucuguacgagaaagugagaagccagcucaagaacaacgccaaggaaaucggcaauggauguuuugaguucuaucacaaaugcgacaacacauguauggaaucagucaagaauggcacuuacgauuauccaaaauacagugaggaagcaaagcugaacagggaggagauugacggggugaaacuugaauccacccggaucuaucaaauucuggccauauacagcacagucgcuucuucauuggugcucguugugagucugggagcgaucagcuuuuggaugugcuccaaugguucuuuacagugccguauuuguaucuga

SEQ ID NO: 128164 - RNA, 1701 nt, Artificial Sequence; identical to SEQ ID NO: 125483
  derived and/or modified sequence opt3 from hemagglutinin__InfluenzaA__ADO29893

SEQ ID NO: 128165 - RNA, 1701 nt, Artificial Sequence
  derived and/or modified sequence opt3 from hemagglutinin__InfluenzaA__ADO29894
augaaggccauccuggugguccuccuuuacaccuucgcuacagcaaacgccgacacucugugcauuggcuaucacgcgaauaacagcacggauaccguugacacaguguuggagaugaauguaacugugacccauuccgucaacuuacuggaagauaaacacaaugggaagcuauguaaacucagaggaguggcuccccugcaucuugguaagugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaaaacauccucauggcccaaucacgauaguaacaagggugucaccgcagccuguccucaugcuggggcaaagagcuucuauaaaaaucugaucuggcuggugaagaaaggaucuuccuacccaaagcucucaaaaagcuauauaaacgacaagggcaaggaaguauuaguucuguggggcauccaccaccccaguacgucugccgaucaacagucccuuuaccagaaugcugacgccuacguguuugucgggacuagccgcuauucgaaaaaguucaaaccugagauugcgauccgaccaaaggugcgugaucaggagggaagaaugaacuacuauuggaccuugguggaacccggugacaaaauuacauuugaggcaacuggcaaucuggucguuccuagguacgccuucgcuauggaacggaacgccgggucuggaaucauaauuuccgauaccccagugcaugacugcaacacaaccugucaaacgccgaagggcgcaaucaauacuucacuacccuuucagaacauucacccuaucacaaucgguaaaugcccaaaguauguaaagaguaccaaacuccgccuggcuacugggcuuagaaaugugcccagcauucaguccaggggacuguucggcgccauagcgggcuuuaucgaagggggauggacagguauggucgacggcugguacggguaucaucaccagaacgaacaaggaucuggcuacgccgcagauuugaagucaacccagaaugcuauugacgagaucacgaacaaagugaauagcguuauagagaagaugaacacccaguucacagccguggguaaagaguucaaucaccucgagaagcggauugaaaaccugaauaagaaagucgaugacggguuuuuagauaucuggacuuacaacgcugagcugcucgugcuucuggaaaaugagcgcaccuuggacuaucaugauaguaacguaaagaaucuauacgagaaaguucgaucccagcugaagaacaacgccaaagaaaucggcaauggauguuucgaguuuuaucacaagugcgacaacacauguauggaaagcgugaagaauggcacuuacgauuauccuaaauacucugaggaagcaaagcucaacagagaggagauugacggggucaaacuggaaucaaccaggaucuaucaaauucuugccauauacaguacaguggcuagcucccuggucuuggugguuucucucggagcgaucucguucuggaugugcagcaaugguucccugcagugccggauuuguaucuga

SEQ ID NO: 128166 - RNA, 1701 nt, Artificial Sequence
  derived and/or modified sequence opt3 from hemagglutinin__InfluenzaA__ADO29895
augaaggccauccugguggcucuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggagucgcaccccugcaucuugguaaaugcaacauagccggcuggauccuggggaauccugagugugaaucuuuuucaacaaguagcuccuggucuuacauuguggagaccucgucaagcgacaacggaacuugcuauccaggcgauuucaucgacuacgaagaguugagggagcagcucaguuccguuucuagcuuugaacgguucgagauuuuuccgaagacauccucauggcccaaucacgauaguaacaagggugugaccgccgcuuguccucaugcaggggccaagagcuucuauaaaaaucugaucuggcuggucaaaaagggaucuuccuacccaaaacucucaaagagcuauauaaacgacaagggcaaagaaguguuaguacuguggggcauccaccaccccaguacgucugcugaucaacagucccuuuaccagaaugccgacgcguacguuuuuguggggacuagccgcuauucgaagaaauucaagccugagauugcaauccgaccaaaaguccgugaucaggagggaagaaugaacuacuauuggaccuugguggaacccggugacaagauuacauuugaggccacuggcaaucugguggucccuagguacgcuuucgccauggaacggaacgcagggucuggaaucauaauuuccgauaccccaguucaugacugcaacacaaccugucaaacgccgaaaggcgcuaucaauacuucacuacccuuucagaacauucacccuaucacaaucgguaagugcccaaaguaugugaaagggaccaagcuccgccuggccacuggacuuagaaauguacccaguauucagagcaggggccuguucggcgcgauagccggguuuaucgagggagguuggacaggcaugguggacgggugguacggauaucaucaccagaacgaacaaggcuccgguuacgcagcugauuugaaaucuacccagaaugccauugacgagaucacgaacaaggucaauagcgugauagagaaaaugaacacccaguucacagcuguugggaaggaguucaaucaccucgaaaagcggauugaaaaccugaauaaaaagguggaugacggcuuuuuagauaucuggacuuacaacgccgagcugcucguccuucuggaaaaugagcgcaccuuggacuaucaugauucaaacgugaaaaaucuauacgagaagguacgaagucagcugaaaaacaacgcaaaggaaaucggaaauggcuguuucgaguuuuaucacaagugcgacaacacauguauggaaagaguuaaaaaugggacuuacgauuauccuaaguacuccgaggaagccaaacucaacagggaggagauugacggagugaagcuggaaagcacccggaucuaucaaauucuugcuauauacucuacagucgcgucaagucugguguuggucgugagccucggugcaaucuccuucuggaugugcucuaauggcucgcugcagugccguauuuguaucuga

SEQ ID NO: 128167 - RNA, 1701 nt, Artificial Sequence
  derived and/or modified sequence opt3 from hemagglutinin__InfluenzaA__ADO29897
augaaggccauccuggugguccuccuuuacaccuucgcuacagcaaacgccgacauucugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuuuucaaccaguagcuccuggucuuacaucguugagacaucgucaagcgacaacggaaagugcuauccaggcgauuucauugacuacgaagaguugagggagcagcucaguuccgugucuagcuuugaacgguucgagaucuuuccgaagaccuccucauggcccaaucacgauaguaacaaaggugucacuacagcauguccucaugccggggcuaagagcuucuauaaaaaucugauauggcuggugaagaaaggaaacucuuacccacgccucuccaagucauauaucaaugacaagggcaaagaaguauuaguucuguggggcauucaccaccccagcaccagugcagaucaacagucucuuuaccagaacgccgacgcuuacguguuugucgggacgucccgauauagcaagaaauucaagccugagaucgccauucguccaaaagugagagaucaggagggaaggaugaauuacuauuggacuuugguggaacccggugacaagaucaccuuugaggcgacaggcaaccuggucguuccucgguacgcauucgccauggaacgcaacgcugggucgggaauaauuaucucugauacuccagugcauggcugcaauaccacaugucaaaccccgaaaggugccauuaacacgucccuacccuuucagaauauccacccuaucacuauugggaagugcccaaaguauguaaaaucaacaaagcucagacuggcaaccggacuuaggaacgugcccaguauacagagccggggccuguucggcgcugucgccggguuuaucgagggagguuggacuggcaugguggacgggugguacggauaucaucaccagaaugaacaaggcuccgguuacgcggccgacuugaaaucuacacagaacgcaauugaugagaucaccaauaagguuaacagcgugauagagaaaaugaauacgcaguucaccgcugucgggaaggaguucaaccaccucgaaaagcgcauugaaaaucugaacaaaaagguggacgauggcuuuuuagacaucuggacauacaaugccgagcugcucguacuucuggaaaacgagcgaacuuuggauuaucaugacucaaauguuaaaaaccuauacgagaaggugagaagucagcugaaaaacaaugcuaaggaaaucggaaacggcuguuucgaguuuuaucacaagugcgauaauaccuguauggaauccgucaaaaacgggacauacgacuauccuaaguacagcgaggaagccaaacucaauagggaggagauugauggagugaagcuggaaucuacucggaucuaucaaauucuugcaauauacucaaccgucgccaguagccugguguugguugugucccucggugcuaucucuuucuggaugugcucgaacggcagccugcagugccguauuuguaucuga

SEQ ID NO: 128168 - RNA, 1701 nt, Artificial Sequence; identical to SEQ ID NO: 125483
  derived and/or modified sequence opt3 from hemagglutinin__InfluenzaA__ADO29898

SEQ ID NO: 128169 - RNA, 1701 nt, Artificial Sequence
  derived and/or modified sequence opt3 from hemagglutinin__InfluenzaA__ADO29899
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggaccuguauuuga

SEQ ID NO: 128170 - RNA, 1701 nt, Artificial Sequence
  derived and/or modified sequence opt3 from hemagglutinin__InfluenzaA__ADO29900
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgaucucaucgacuacgaggagcugagggagcagcugagcaguguguccucuuuugaacgguucgagauuuuuccgaagacaagcuccuggcccaaucacgaucucaacaagggugucaccgccgcuuguccucaugcaggggccaaaucauucuauaagaauuuaaucuggcuggugaaaaagggaaacaguuacccaaaacuuagcaagucuuauauaaaugacaagggcaaagaaguauugguucuguggggcauccaccaccccuccacgucagcugaucaacagagccuauaccagaacgccgacgcguacguguuugucgggaccagucgcuauucuaagaaauccaagccugagauugcaauccgaccaaaagugcgugaucaggagggaagaaugaauuacuauuggacucucguggaacccggugacaagauuacauucgaggccacuggcaaccuggucguuccuagguacgcuuuugccauggaacggaacgcagggagcggaaucauaauuucggauaccccagugcaugacugcaauacaaccugucaaacgccgaaaggcgcuaucaacacuucucuucccuuccagaauauucacccuaucacaaucgguaagugcccaaaguauguacgcuccaccaaacugagauuggccacugggcucaggaacgugcccucaauucagagucggggacuguuuggcgcgauagccggcuucaucgaagggggauggacagguauggucgacggcugguacggguaucaucaccagaaugaacaaggaagcggcuacgcagcugauuuaaaguccacccagaacgccauugacgagaucacgaauaaagugaacucuguuauagagaagaugaauacccaguuuacagcuguggguaaagaguucaaccaccuggaaaagcgcauugaaaaucucaacaagaaagucgaugacggguuucuugauaucugggccuacaaugcagagcuguuggugcuacuggaaaacgagcgaacucucgacuaucaugauagcaauguaaagaaccuguacgagaaaguuagaucacagcuuaagaacaaugccaaagaaaucggcaacggauguuucgaguucuaucacaagugcgacaauaccuguauggaaagugugaagaacggcacauacgauuauccuaaauacuccgaggaagcuaagcugaauagggaggagauugacggggucaaauuggaaagcacucggaucuaucaaauucucgcgauauacucuaccguggcaucaagucuggucuuagugguuagccugggagccaucuccuuuuggaugugcucuaacgguucgcuacagugccguauuuguaucuga

SEQ ID NO: 128171 - RNA, 1701 nt, Artificial Sequence
  derived and/or modified sequence opt3 from hemagglutinin__InfluenzaA__ADO29901
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgcuaaaaaggggaacagcuacccaaaagugucuaaguccuauauaaaugacaagggaaaagagguauuaguucuguggggcauccaccaccccucaacgagcgccgaucaacagagucuuuaccagaacgcggacgcauacguguucgucggcacuucucgcuauuccaagaaauuuaagccugagauugccauccgaccaaaagugcgugaucaggaagggagaaugaauuacuauuggaccuugguggagcccggagacaagauuacauucgaagcuacugguaaccuggucguuccuagguacgccuuugcaauggagcggaacgcuggcagcgggaucauaauuucggauaccccagugcaugacugcaauacaaccugucaaacgccgaaaggagccaucaacacuucucuacccuuccagaauauucacccuaucacaaucggcaagugcccaaaguauguaaaauccaccaagcuccgccuggcgacuggucuuagaaacgugcccucaauucagaguagggggcuguuuggagccauagcaggcuucaucgaaggcggguggacaggaauggucgacgguugguacggcuaucaucaccagaaugagcaagggagcggauacgcugccgauuugaaauccacccagaacgcuauugacgagaucacgaauaaggugaacucuguuauagaaaagaugaauacccaguuuacagccgugggcaaagaguucaaccaccucgaaaagcggauugagaaucugaacaaaaaggucgaugacgguuucuuagauaucuggacuuacaaugcagaacugcucgugcuucuggagaacgagcgcaccuuggacuaucaugauagcaauguuaaaaaccuauacgaaaagguacgaucacagcugaaaaacaaugccaaggagaucgggaacggcuguuuugaguucuaucacaagugcgacaauacauguauggaaagugugaaaaacggaacuuacgauuauccuaaguacuccgaagaggcuaaacucaauagagaggaaauugacggcgucaagcuggagagcaccaggaucuaucaaauucuugcgauauacucuacaguggcaucaagucuggucuuggugguuagccucggggccaucuccuuuuggaugugcuucaacggaucucugcagugccggauuuguaucuga

SEQ ID NO: 128172 - RNA, 1701 nt, Artificial Sequence
  derived and/or modified sequence opt3 from hemagglutinin__InfluenzaA__ADO29902
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaggcgugaagaacgggacuuacgauuauccuaaauacagugaagaggccaagcugaauagagaagagauugacggagucaaacuugaguccaccaggaucuaucaaauucuggcuauauacagcacaguggcgucuucauugguccucgugguuagucugggugcaaucagcuuuuggaugugcuccaacggcucuuuacagugccggauuuguaucuga

SEQ ID NO: 128173 - RNA, 1701 nt, Artificial Sequence
  derived and/or modified sequence opt3 from hemagglutinin__InfluenzaA__ADO29903
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacacagccggcuggauacuggggaauccugagugugaaucuuugucaaccgcaaguagcugguccuacaucguugagacuucuucgucagacaacggaacaugcuauccaggcgauuuuauugacuacgaggagcucagggagcagcugagcaguguguccucuuucgaacgguuugagaucuucccgaagaccagcuccuggcccaaucacgauccuaacaagggugucacggccgcuuguccacaugcaggggccaaaucauuuuauaagaaucugauuuggcucgugaaaaagggaaacaguuaccccaaauuaagcaagucuuauaucaaugacaagggcaaagaaguacugguucuuuggggcauacaccacccuuccacuucagcugaucaacagagcuuguaccagaacgccgacgcguacguguucgucgggaccagucgcuauucuaagaaauuuaagccagagaucgcaauucgacccaaagugcgugaucaggagggaagaaugaauuacuauuggacacugguggaaccuggugacaagaucacuuucgaggccaccggcaaccuagucguuccaagguacgcuuuugccauggaacggaacgcaggguccggaauuaucauaagcgauacaccggugcaugacugcaauaccacgugucaaacucccaaaggcgcuauuaacacaucgcucccuuuccagaauauccacccaauuaccaucgguaagugccccaaguauguaaaaucuacuaagcugcgccuugccacagggcugagaaacgugccuuccauccagucaaggggauuguuuggcgcgauugccggcuucauagaagggggauggaccgguauggucgacggcugguacggguaucaucaccagaaugaacaaggaaguggcuacgcagcugaucucaaaagcacgcagaacgccaucgacgagauuaccaauaaggugaacuccguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauucuaauguaaagaaccuguacgagaagguucgaagccagcucaaaaacaaugcaaaggaaaucggcaacggauguuuugaguucuaucacaagugcgacaauacuuguauggaaucagugaaaaacggcaccuacgauuauccaaaguacagugaggaagccaaacugaauagagaggagaucgacggggucaaacuugaauccacaaggauuuaucaaauccuggcuauuuacagcaccguggcgucuucauugguccucgugguuagucugggagcaaucagcuuuuggaugugcuccaacgguucuuuacagugccggauauguauuuga

SEQ ID NO: 128174 - RNA, 1701 nt, Artificial Sequence
  derived and/or modified sequence opt3 from hemagglutinin__InfluenzaA__ADO29904
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaggugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauccuaacaagggugucaccgccgcuuguccacaugcaggggccaagucauuuuauaaaaaucugaucuggcucgugaagaaaggaaacaguuaccccaaguuaagcaaaucuuauauaaaugacaagggcaaggaaguacugguucuuuggggcauccaccgaccuuccacgucagcugaucaacagagcuuguaccagaacgccgacgcguacguguucgucgggacuucccguuauucuaaaaaguuuaaaccagagauugcaaucagacccaaggugggagaucaggaggguaggaugaauuacuauuggacccugguggaaccuggcgacaaaauuacauucgaggccacugggaaccuagucguuccacgguacgcuuuugccauggaacgcaacgcaggauccggcaucauaauuagcaauaccccggugcacgauugcaacacaaccugucaaacgcccaagggugcuaucaauacuucgcucccuuuccagaacauucauccaaucacaaucgggaaaugccccaaguauguaaagucuaccaaacugagacuugccacuggacugaggaaugugccuuccauucagucacggggcuuguuuggcgcgauagccggguucaucgagggagguuggacaggcauggucgacgggugguacggauaucaccaucagaacgaacaaggcagugguuacgcagcugaccucaagagcacccagaaugccauugaugagaucacgaacaaagugaauaguguuauagagaagaugaacacccaguuuacagcuguggggaaagaguucaaucaccuggagaagcgcauugaaaacuuaaauaagaaagucgacgauggcuuccuggacaucuggacuuacaacgccgagcuccuugugcuguuggaaaaugagcgaacccuagauuaucacgacucuaacguaaagaaccuguacgagaaaguuagaagccagcucaagaauaacgcaaaagaaaucggaaauggcuguuuugaguucuaucauaagugcgauaacacauguauggaaucagugaagaaugggacuuacgacuauccaaaauacagugaggaagccaagcugaacagggaggagauugauggagucaaacuugaauccacccggaucuaucaaauucuggcuauauacagcacaguggcgucuucauugguccucgugguuagucugggugcaaucagcuuuuggaugugcuccaauggcucuuuacagugccguauuuguaucuga

SEQ ID NO: 128175 - RNA, 1701 nt, Artificial Sequence
  derived and/or modified sequence opt3 from hemagglutinin__InfluenzaA__ADO29905
augaaggccauccuggugguccuccuuuacaccuucgcuacagcaaacgccgacacucugugcauuggcuaucacgcgaauaacagcacggauaccguugacacaguguuggagaaaaauguaacugugaccagauccgucaacuuacuggaagauaagcauaaugggaaacuauguaagcucaggggaguggcuccccugcaccuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaagacaagcuccuggcccaaucaugauccuaacaagggugucaccgccgcuuguccacacgcaggggccaaaucauuuuauaagaaucugaucuggcucgugaaaaagggaaacaguuaccccaaauuaagcaagucuuauauaaaugacaagggcaaagaaguacugguucuuuggggcauccaucacccuuccacgucagcugaucaacagagcuuguaccagaacgccgacgcguacguguucgucgggacuucccgauauucuaagaaauuuaagccagagauugcaauccgucccaaagugagagaucaggagggaaggaugaauuacuauuggacccugguggaaccuggugacaagauuacauucgaggccacuggcaaccuagucguuccacgguacgcuuuugccauggaacgcaacgcaggguccggaaucauaauuagcaauaccccggugcacgauugcaacacaaccugucaaacgcccaaaggcgcuaucaauacuucgcucccuuuccagaacauucauccaaucacaaucgguaagugccccaaguauguaaaaucuaccaagcugagacuugccacugggcugaggaaugugccuuccauucagucacggggauuguuuggcgcgauagccggcuucaucgaagggggauggacagguauggucgacggcugguacggguaucaccaucagaacgaacaaggaaguggcuacgcagcugaccucaaaagcacccagaaugccauugaugagaucacgaacaaggugaauaguguuauagagaaaaugaacacccaguuuacagcuguggguaaggaguucaaucaccuggaaaagcgcauugaaaacuuaaauaaaaaggucgacgauggguuccuggacaucuggacuuacaacgccgagcuccuugugcuguuggaaaaugagcgaacccuagauuaucacgacucuaacguaaagaaccuguacgagaagguuagaagccagcucaaaaauaacgcaaaggaaaucggcaauggauguuuugaguucuaucauaagugcgauaacacauguauggaaucagugaaaaauggcacuuacgacuauccaaaguacagugaggaagccaaacugaacagggaggagauugauggggucaaacuugaauccacccggaucuaucaaauucuggcuauauacagcacaguggcgucuucauugguccucgugguuagucugggagcaaucagcuuuuggaugugcuccaaugguucuuuacagugccguauuuguaucuga

SEQ ID NO: 128176 - RNA, 1701 nt, Artificial Sequence
  derived and/or modified sequence opt3 from hemagglutinin__InfluenzaA__ADO29906
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaauagaaaacuauguaagcucagggguguggcuccccugcaucuuggaaaaugcaacauagccgguuggauccugggcaauccugagugugaaucuuugucaacagcaaguagcugguccuacauuguugagaccucuucgucagacaacgggacuugcuauccaggagauuuuaucgacuacgaagaacuccgggagcagcugagcaguguguccucuuucgaacgcuuugagauuuucccgaagacaagcuccuggcccaaucacgauccuaacaagggcgucaccgccgcuuguccacaugcaggggccaaaucauuuuauaagaaucugaucuggcucgugaaaaaggggaacaguuaccccaaauuaagcaagucuuauauaaaugacaagggaaaagaaguacugguucuuuggggcauccaccacccuuccacgucagcugaucaacagagcuuguaccagaacgccgacgcguacguguucgucggcaccagucgauauucuaagaaauuuaagccagagauugcaauccgucccaaagugagagaucaggaggggaggaugaauuacuauuggacucugguggaaccuggagacaagauuacauucgaggccacugguaaccuagucguuccacgguacgcuuuugccauggaacgcaacgcaggcuccgggaucauaauuagcgauaccccggugcaugacugcaauacaaccugucaaacgcccaaaggagcuaucaacacuucgcucccuuuccagaauauucacccaaucacaaucggcaagugccccaaguauguaaaaucuaccaagcugagacuugccacuggucugaggaacgugccuuccauucagucacggggguuguuuggagcgauagccggcuucaucgagggcggguggacaggaauggucgacgguugguacggcuaucaucaccagaaugaacaagggaguggauacgcagcugaucucaaaagcacccagaacgccauugacgagaucacgaauaaggugaacuccguuauagagaaaaugaauacccaguuuacagcugugggcaaggaguucaaccaccuggagaagcgcauugaaaauuuaaacaaaaaggucgaugacgguuuccuggauaucuggacuuacaaugccgagcuccuugugcuguuggaaaacgagcgaacccuagacuaucaugauucuaauguaaagaaccuguacgagaagguuagaagccagcucaaaaacaaugcaaaggaaaucgggaacggcuguuuugaguucuaucacaagugcgacaauacauguauggaaucagugaaaaacggaacuuacgauuauccaaaguacagugaggaagccaaacugaauagggaggagauugacggcgucaaacuugaauccacccggaucuaucaaauucuggcuauauacagcacaguggcgucuucauugguccucgugguuagucugggggcaaucagcuuuuggaugugcuccaacggaucuuuacagugccguauuuguaucuga

SEQ ID NO: 128177 - RNA, 1701 nt, Artificial Sequence
  derived and/or modified sequence opt3 from hemagglutinin__InfluenzaA__ADO29907
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaacugaagccagagauugcaauccgacccaaagugcgugaucaggagggaagaaugaauuaccauuggacucuaguggaaccuggugacaagauuacauuugaggccacuggcaaccucgucguuccaagguaugcuuucgccauggaacggaacgcaggguccggaaucauaauuagcgauaccccggugcacgacugcaauacaaccugucaaacgcccaaaggcgcuaucaacacuucgcugccuuuucagaauauucauccaaucacaaucgguaagugccccaaguacguaaaaucuaccaaacuucgccuggccacuggguugagaaacgugccuuccauucagucaaggggacucuucggcgcgauagccggcuuuaucgaagggggauggacagguauggucgacggcugguauggguaccaccaccagaaugaacaaggaaguggcuaugcagcugaucugaaaagcacccagaacgccauugacgagaucacgaauaaggugaacuccguuauagagaaaaugaauacccaguucacagcuguggguaaggaauuuaaccauuuagagaagcggauugaaaaucugaacaaaaaggucgaugacggguuccucgauaucuggacuuacaaugccgagcuucugguguugcuagaaaacgagcgcacccuggacuaccacgauucuaauguaaagaaccucuaugagaagguucgaagccagcugaaaaacaaugcaaaggaaaucggcaacggauguuucgaguuuuaccauaagugcgacaauacauguauggaaucagugaaaaacggcacuuaugauuacccaaaguauagugaggaagccaaacuuaauagagaggagauugacggggucaagcuggaauccaccaggaucuaccaaauuuuggcuauauauagcacaguggcgucuucacucguccuggugguuaguuuaggagcaaucagcuucuggaugugcuccaacgguucucugcagugccggauuuguaucuga

SEQ ID NO: 128178 - RNA, 1701 nt, Artificial Sequence
  derived and/or modified sequence opt3 from hemagglutinin__InfluenzaA__ADO29908
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggaguggagaaugaauuacuauuggacucugguggaaccuggagacaagauuacauucgaggccacugguaaccuagucguuccaagguacgcuuuugccauggaacggaacgcaggcuccgggaucauaauuagcgauaccccggugcaugacugcaauacaaccugucaaacgcccaaaggagcuaucaacacuucgcucccuuuccagaauauucacccaaucacaaucggcaagugccccaaguauguaaaaucuaccaagcugcgccuugccacuggucugagaaacgugccuuccauucagucaaggggguuguuuggagcgauagccggcuucaucgagggcggguggacaggaauggucgacgguugguacggcuaucaucaccagaaugaacaagggaguggauacgcagcugaucucaaaagcacccagaacgccauugacgagaucacgaauaaggugaacuccguuauagagaaaaugaauacccaguuuacagcugugggcaaggaguucaaccaccuggagaagcggauugaaaauuuaaacaaaaaggucgaugacgguuuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucgggaacggcuguuuugaguucuaucacaagugcgacaauacauguauggaaucagugaaaaacggaacuuacgauuauccaaaguacagugaggaagccaaacugaauagagaggagauugacggcgucaaacuugaauccaccaggguguaucaaauccuggcuacauacagcaccgucgcgucuucauuggugcucguugugagucugggggcaauuagcuuuuggaugugcuccaacggaucuuuacagugccggauauguaucuga

SEQ ID NO: 128179 - RNA, 1701 nt, Artificial Sequence
  derived and/or modified sequence opt3 from hemagglutinin__InfluenzaA__ADO29909
augaaggccauccuggugguccuccuuuacaccuucgcuacagcaaacgccgacacucugagaauuggcuaucacgcgaauaacagcacggauaccguugacacaguguuggagaaaaauguaacugugacccauuccgucaacuuacuggaagauaagcacaaugggaaacuaugcaagcucaggggaguggcuccccugcaucuugguaaauguaacauagccggcuggauccuggggaauccugagugcgaaucuuugucaacagcaaguagcugguccuacauuguugagaccucuucgucagacaacggaacuuguuauccaggcgauuuuaucgacuacgaggagcuccgggagcagcugagcaguguguccucuuucgaacgcuuugagauuuucccgaagacaagcuccuggcccaaucacgauccuaacaagggugucaccgccgcuugcccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgauauucuaagaaauuuaagccagagauugcaauccgucccaaagugagagaucaggagggaaggaugaauuacuauuggacucugguggaaccuggugacaagauuacauucgaggccacuggcaaccuagucguuccacgguacgcuuuugccauggaacgcaacgcaggguccggaaucauaauuagcgauaccccggugcaugacuguaauacaaccugccaaacgcccaaaggcgcuaucaacacuucgcucccuuuccagaauauucacccaaucacaaucgguaagugucccaaguauguaaaaucuaccaagcugagacuugccacugggcugaggaacgugccuuccauucagucacggggauuguuuggcgcgauagccggcuucaucgaagggggauggacagguauggucgacggcugguacggguaucaucaccagaaugaacaaggaaguggcuacgcagcugaucucaaaagcauucagaacgccaucgacgagauaaccaauaaggugaacuccguuauugagaaaaugaauacgcaguuuaccgcuguggguaaggaguucaaccaccuggaaaagcgcaucgaaaauuuaaacaaaaaggucgaugacggguuccuggauaucuggacauacaaugccgagcuccuugugcuguuggaaaacgagcgaacucuagacuaucaugauucuaauguaaagaaccuguacgagaagguuagaagccagcucaaaaacaaugcaaaggaaauuggcaacggaugcuuugaguucuaucacaagugugacaauaccugcauggaaucagugaaaaacggcacauacgauuauccaaaguacagugaggaagccaaacugaauagggaggagaucgacggggucaaacuugaauccacucggauuuaucaaauacuggcuaucuacagcaccguggcgucuucauugauucucgucgugagucugggagcaaucagcuuuuggauguguuccaacgguucuuuacagugccguaucugcauuuga

SEQ ID NO: 128180 - RNA, 1701 nt, Artificial Sequence
  derived and/or modified sequence opt3 from hemagglutinin__InfluenzaA__ADO29910
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcccagaggaguggcuccucuccaucuggguaaaugcaacauagccggcuggauccuugggaauccagagugugaaucucugucaacagcaaguagcugguccuacauuguugagaccucuucgucagacaacggaacuugcuauccgggcgauuuuaucgacuacgaagaguugagggagcagcucagcaguguguccucuuucgaacgguuugagauuuuccccaagacaagcuccuggccuaaucacgauccaaacaagggugucaccgccgcuuguccccaugcaggggccaaaucauuuuauaagaaucugaucuggcuggugaaaaagggaaacaguuacccuaaacucagcaagucuuauauaaaugacaagggcaaagaaguauuaguucuguggggcauccaccacccauccacgucagcugaucaacagagccuuuaccagaacgccgacgcguacguguucgucgggaccagucgcuauucuaagaaauuuaagcccgagauugcaauccgaccuaaagugcgugaucaggagggaagaaugaauuacuauuggacuuugguggaaccaggugacaagauuacauucgaggccaucggcaaccuggucguuccgagguacgcuuuugccauggaacggaacgcaggguccggaauaauuaucagcgauacucccgugcaugacugcaauaccacaugucaaaccccuaaaggcgcuauuaacacgucgcuaccauuccagaauauccaccccaucacuauugguaagugcccuaaguauguaaaaucuacaaagcuccgccuggccaccgggcuuagaaacgugccauccauacagucaaggggacuguuuggcgcgaucgccggcuucauugaagggggauggacugguauggucgacggcugguacggguaucaucaccagaaugaacaaggaaguggcuacgcagcugauuugaaaagcacacagaacgccaucgacgagauaaccaauaaggugaacuccguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucuaauguuaaaaaccuauacgagaagguacgaagccagcugaaaaacaaugcaaaggaaauuggcaacggauguuuugaguucuaucacaagugcgacaauaccuguauggaaucagugaaaaacggcacauacgauuaucccaaguacagugaggaagccaaacucaauagaggggagaucgacggagucaagcuggaguccacuaggauuuaucaaauacuugcuaucuacagcaccguggcgucuucacuggucuuggugguuagucucggugcaauuagcuuuuggaugugcuccaacggcucucugcagugccggaucuguaucuga

SEQ ID NO: 128181 - RNA, 1701 nt, Artificial Sequence; identical to SEQ ID NO: 126407
  derived and/or modified sequence opt3 from hemagglutinin__InfluenzaA__ADO30407

SEQ ID NO: 128182 - RNA, 1701 nt, Artificial Sequence; identical to SEQ ID NO: 126298
  derived and/or modified sequence opt3 from hemagglutinin__InfluenzaA__ADO30417

SEQ ID NO: 128183 - RNA, 1701 nt, Artificial Sequence; identical to SEQ ID NO: 126020
  derived and/or modified sequence opt3 from hemagglutinin__InfluenzaA__ADO33202

SEQ ID NO: 128184 - RNA, 1701 nt, Artificial Sequence; identical to SEQ ID NO: 125528
  derived and/or modified sequence opt3 from hemagglutinin__InfluenzaA__ADO33240

SEQ ID NO: 128185 - RNA, 1701 nt, Artificial Sequence; identical to SEQ ID NO: 124685
  derived and/or modified sequence opt3 from hemagglutinin__InfluenzaA__ADO33247

SEQ ID NO: 128186 - RNA, 1701 nt, Artificial Sequence; identical to SEQ ID NO: 125528
  derived and/or modified sequence opt3 from hemagglutinin__InfluenzaA__ADO33254

SEQ ID NO: 128187 - RNA, 1701 nt, Artificial Sequence; identical to SEQ ID NO: 125528
  derived and/or modified sequence opt3 from hemagglutinin__InfluenzaA__ADO33261

SEQ ID NO: 128188 - RNA, 1701 nt, Artificial Sequence; identical to SEQ ID NO: 125528
  derived and/or modified sequence opt3 from hemagglutinin__InfluenzaA__ADO33269

SEQ ID NO: 128189 - RNA, 1701 nt, Artificial Sequence; identical to SEQ ID NO: 126020
  derived and/or modified sequence opt3 from hemagglutinin__InfluenzaA__ADO33277

SEQ ID NO: 128190 - RNA, 1701 nt, Artificial Sequence; identical to SEQ ID NO: 125528
  derived and/or modified sequence opt3 from hemagglutinin__InfluenzaA__ADO33285

SEQ ID NO: 128191 - RNA, 1701 nt, Artificial Sequence; identical to SEQ ID NO: 126020
  derived and/or modified sequence opt3 from hemagglutinin__InfluenzaA__ADO33293

SEQ ID NO: 128192 - RNA, 1701 nt, Artificial Sequence; identical to SEQ ID NO: 126020
  derived and/or modified sequence opt3 from hemagglutinin__InfluenzaA__ADO33307

SEQ ID NO: 128193 - RNA, 1701 nt, Artificial Sequence; identical to SEQ ID NO: 125528
  derived and/or modified sequence opt3 from hemagglutinin__InfluenzaA__ADO33313

SEQ ID NO: 128194 - RNA, 1701 nt, Artificial Sequence; identical to SEQ ID NO: 127778
  derived and/or modified sequence opt3 from hemagglutinin__InfluenzaA__ADO33329

SEQ ID NO: 128195 - RNA, 1701 nt, Artificial Sequence; identical to SEQ ID NO: 125528
  derived and/or modified sequence opt3 from hemagglutinin__InfluenzaA__ADO33337

SEQ ID NO: 128196 - RNA, 1701 nt, Artificial Sequence; identical to SEQ ID NO: 125528
  derived and/or modified sequence opt3 from hemagglutinin__InfluenzaA__ADO33345

SEQ ID NO: 128197 - RNA, 1701 nt, Artificial Sequence; identical to SEQ ID NO: 126020
  derived and/or modified sequence opt3 from hemagglutinin__InfluenzaA__ADO33352

SEQ ID NO: 128198 - RNA, 1701 nt, Artificial Sequence; identical to SEQ ID NO: 124685
  derived and/or modified sequence opt3 from hemagglutinin__InfluenzaA__ADO33360

SEQ ID NO: 128199 - RNA, 1701 nt, Artificial Sequence; identical to SEQ ID NO: 125528
  derived and/or modified sequence opt3 from hemagglutinin__InfluenzaA__ADO33368

SEQ ID NO: 128200 - RNA, 1701 nt, Artificial Sequence; identical to SEQ ID NO: 125528
  derived and/or modified sequence opt3 from hemagglutinin__InfluenzaA__ADO33376

SEQ ID NO: 128201 - RNA, 1701 nt, Artificial Sequence; identical to SEQ ID NO: 124672
  derived and/or modified sequence opt3 from hemagglutinin__InfluenzaA__ADO33384

SEQ ID NO: 128202 - RNA, 1701 nt, Artificial Sequence; identical to SEQ ID NO: 124685
  derived and/or modified sequence opt3 from hemagglutinin__InfluenzaA__ADO33391

SEQ ID NO: 128203 - RNA, 1701 nt, Artificial Sequence
  derived and/or modified sequence opt3 from hemagglutinin__InfluenzaA__ADO79917
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcauaauugcaacacaaccugucagacgccgaaaggcgcuaucaauacuucucuccccuuccaaaacauucacccuaucacaaucgguaagugcccaaaguauguaaaauccaccaagcugagacuugccacugggcugaggaaugugcccucaauucagagucggggauuguuuggcgcgauagccggcuucaucgaagggggauggacagguauggucgacggcugguacggguaucaucaccagaacgaacagggaagcggcuacgcagcugaccucaaauccacccaaaaugccauugaugagaucacgaacaagguaaauucuguuauagagaaaaugaacacccaguuuacagcuguggguaaggaguucaaucaccuggaaaagcgcauugaaaacuuaaauaaaaaggucgacgauggguuccuggacaucuggacuuacaacgccgagcuccuugugcuguuggaaaaugagcgaacccuagauuaucaugacagcaacgugaaaaaccuguacgagaagguuagaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagggaggagauugauggggucaaacuugaaagcacccggaucuaucagauucuggcuauauacucuacaguggcgucaaguuugguccucgugguuagccugggagcaaucuccuuuuggaugugcucuaaugguucguuacaaugccguauuuguaucuga

SEQ ID NO: 128204 - RNA, 1701 nt, Artificial Sequence
  derived and/or modified sequence opt3 from hemagglutinin__InfluenzaA__ADO79923
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaggaacucagggagcagcugucaagcgugaguuccuucgaacgguuugagauuuucccgaagaccucuagcuggcccaaccacgauuccaauaaaggcgucacggccgcuuguccucaugccggugcaaagucauuuuauaaaaaccugaucuggcucgugaagaaagggaauaguuacccaaaguuaagcaagucuuauauaaacgacaaaggaaaggaaguacugguucuuuggggcauccaccaccccuccacuucagcugaucaacagagcuuguaccagaaugccgacgcguacguguucgucggcaccagucgcuauucuaaaaaguuuaaaccugagauugcaauccgaccaaaggugcgugaucaggagagaaggaugaacuacuauuggacacuggugcaacccggggacaaaauuacuuuccaggccaccggaaaucuagucguuccucgguacgcuuuugccauggaacgcaacgcagguuccggcaucauaauuagcgauacaccagugcauaacugcaauaccacgugucagacuccgaagggggcuaucaacacaucgcuccccuuccagaauauucacccuaucaccaucggaaagugcccaaaauauguaaagucuacuaaacugagacuugccacaggccugaggaacgugcccuccauucaaucacgggguuuguuuggggcgauagccggauucaucgagggcggcuggaccgggauggucgacggaugguacgguuaucaucaccagaaugaacagggcaguggguacgcagcugaccucaagagcacgcagaacgccauugaugagaucaccaauaaagugaacuccguuauagaaaagaugaauacacaauuuacugcugugggaaaggaguucaaccaccuggagaaacgcauugaaaauuuaaacaagaaagucgacgauggcuuccuggacaucuggaccuacaaugccgagcuccuugugcuguuggaaaacgagcgaacacuagauuaucaugacucuaauguaaagaaccuguacgaaaaaguuagaagccagcucaagaacaaugcaaaggagaucgguaacggguguuuugaguucuaucacaaaugcgauaauacuuguauggaaucagugaagaacggcaccuacgacuauccuaaauacagugaggaagccaagcugaauagggaggaaauugauggagucaaacuugaguccacacggaucuaucagauucuggcuauauacagcaccguggcgucuucauugguccucgugguuagucugggcgcaaucagcuuuuggaugugcuccaacgggucuuuacaaugccguauuuguaucuga

SEQ ID NO: 128205 - RNA, 1701 nt, Artificial Sequence
  derived and/or modified sequence opt3 from hemagglutinin__InfluenzaA__ADO79924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaagaacucagggagcagcugucaagcgugaguuccuucgaacgguuugagauuuucccgaagaccucuagcuggcccaaccacgauuccaauaaaggcgucacggccgcuuguccucaugccggugcaaagucauuuuauaaaaaccugaucuggcucgugaagaaagggaauaguuacccaaaguuaagcaagucuuauauaaacgacaaaggaaaggaaguacugguucuuuggggcauccaccaccccuccacuucagcugaucaacagagcuuguaccagaaugccgacgcguacguguucgucggcaccagucgcuauucuaaaaaguuuaaaccugagauugcaauccgaccaaaggugcgugauagagaggggaggaugaacuacuauuggacacugauugaacccggagacaaaaucacuuucgagccuaccgguaaucuaguggucccacgguacgccuuugcuauggaacgcaacgccggcuccgggauaauuaucagcgauacaccgguucauaacugcaauaccacgugucagacucccaagggagcaauuaacacaucgcucccuuuccaaaauauccacccaaucaccauuggcaagugccccaaauaugugaagucuacuaaacugagacuugcuacaggucugaggaacguaccuuccauacagucacggggguuguuuggagccaucgcgggcuucauugagggcggguggaccggaaugguggacgguugguacggcuaucaucaccagaaugaacaggggaguggauacgccgcagaccucaagagcacgcaaaacgcuaucgaugagauaaccaauaaagucaacuccgugauugagaagaugaauacacaguuuacugccguuggcaaggaguucaaccaccuggagaaacgcaucgaaaauuuaaacaagaaaguggacgaugguuuccuggacaucuggaccuacaaugcugagcuccuuguccuguuggaaaacgagcgaacacuagauuaucaugacucuaaugugaagaaccuguacgagaaaguaagaagccagcucaagaacaaugccaaggaaauugggaacggcuguuuugaguucuaucacaaaugcgauaauacuuguauggaaucaguuaagaacggaaccuacgacuauccaaaauacagugaggaagcaaagcugaauagggaggagaucgauggcgugaaacuugaauccacacggauuuaucagauacuggccaucuacagcaccgucgcuucuucauuggugcucgucgugagucugggggcgauuagcuuuuggaugugcuccaacggaucuuuacaaugccguaucuguaucuga

SEQ ID NO: 128206 - RNA, 1701 nt, Artificial Sequence
  derived and/or modified sequence opt3 from hemagglutinin__InfluenzaA__ADO79925
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacucacgaauggacaugcuauccaggagacuuuaucgauuacgaggagcucagggaacagcugucaagcgugaguuccuucgagcgguuugaaauuuucccgaagaccucuagcuggcccaaccaugacuccaauaagggcgucacggccgcuuguccucacgccggugcaaaaucauuuuauaagaaccugaucuggcucgugaaaaaggggaauaguuacccaaaauuaagcaagucuuauauaaacgauaagggaaaagagguacugguucuuuggggcauccaccaucccuccacuucagcugaccaacagagcuuguaccagaaugccgaugcguacguguucgucggcaccagucgcuauucuaagaaauuuaagccugagauugcaauccgaccaaaagugcgugacagagaagggaggaugaacuacuauuggacacugguggagcccggagauaagauuacuuucgaagccccugguaaucuagucguuccacgguacgcuuuugccauggagcgcaacgcaggcuccgggaucauaauuagcgacaccccggugcacaacugcaauacaaccugucagacgcccaaaggagcuaucaacacuucgcucccuuuccaaaauauucauccaaucaagaucggcaagugcucuaaauauguaaaguccacaaaacugagacuugccaccggucugaggaacgugcccucaauucagagucggggguuguuuggagcgauagccggcuucaucgaaggcggguggacuggaauggucgaugguugguacggcuaucaccaccagaaugagcaggggagcggauacgcagcugaccucaaguccacacaaaacgccauugacgagaucaccaauaaagugaacucuguuauagaaaagaugaauacgcaguuuaccgcugugggcaaggaguucaaccaucuggaaaaacgcauugagaauuuaaacaagaaagucgaugacgguuuccuggauaucuggacauacaaugccgaacuccuugugcuguuggagaacgagcgaacucuagacuaucacgauagcaauguaaagaaccuguacgaaaaaguuagaucacagcucaagaacaaugcaaaggagaucgggaacggcuguuuugaguucuaucauaaaugcgacaauaccuguauggaaagugugaagaacggaacauacgauuauccuaaauacuccgaagaggccaagcugaauagggaggaaauugacggcgucaaacuugagagcacucggaucuaucagauucuggcuauauacucuaccguggcgucaaguuugguccucgugguuagccugggggcaaucuccuuuuggaugugcucuaacggaucguuacaaugccguauuuguaucuga

SEQ ID NO: 128207 - RNA, 1701 nt, Artificial Sequence
  derived and/or modified sequence opt3 from hemagglutinin__InfluenzaA__ADO79926
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaggaacucagggagcagcugucaagcgugaguuccuucgaacgguuugagauuuucccgaagaccucuagcuggcccaaccacgauuccaauaaaggcgucacggccgcuuguccucaugcaggggccaagucauuuuauaaaaaccugaucuggcucgugaagaaagggaauaguuucagcaaguuaucuaagacuuaccugaacgacaaaggaaaggaaguacuuguuuuguggggcauacaccacccauccaccucagcugaucaacagagccuguaucagaaugccgacgcguacguguuugucggcacaagucgcuacucuaaaaaguucaaacccgagaucgcaauucgaccuaaggugcgugaucaggaggggagaaugaacuauuacuggacucuaguggaaccaggagacaaaaucaccuuugaggccacagguaaucucgucguucccagguaugcuuucgccauggaacggaacgugggcuccgggauuaucauaagcgauaccccuguacaugacugcaacacgacuugucaaacaccaaagggagcaauuaauaccucgcugccguuucagaacauccaccccauuacuaucggcaagugcccuaaauacgugaagucuacaaaacuucgccuggcuaccgguuugagaaaugucccauccauccagucaaggggucucuucggagccauugcgggcuuuauagagggcggguggacgggaaugguggacgguugguauggcuaccaucaccagaacgaacaagggaguggauaugccgcagaucuuaagagcacccagaaugcuaucgacaaaauuacaaacaagguuaauuccgugaucgagaagaugaacacucaguucaccgccgucggcaaagaguucaaucacuuagaaaagcggauagagaaccugaauaaaaagguggaugacgguuuucucgauauuuggacauacaacgcugaacuucugguauugcuagagaaugaacgcacucuggacuaccaugauucuaacguuaaaaaucucuaugagaaggugcgaagccagcugaagaacaacgccaaagagaugaagaauggguguuucgaauuuuaccacaaaugcgacaacaccuguauggagucagucaagaauggcacauaugauuaccccaaauauagugaagaggcaaagcugaacagagaagagaucgacggagugaagcuggaguccaccaggaucuaccaaauuuuggccaucuauagcacugucgcuucuucacucgugcugguugugaguuuaggcgcgauuagcuucuggaugugcuccaaugggucucugcagugccggauauguaucuga

SEQ ID NO: 128208 - RNA, 1701 nt, Artificial Sequence
  derived and/or modified sequence opt3 from hemagglutinin__InfluenzaA__ADO79927
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaagaacucagggagcagcugucaagcgugaguuccuucgaacgguuugagauuuucccgaagaccucuagcuggcccaaccacgauuccaauaaaggcgucacggccgcuuguccucaugcagccgcuaagucauuuuauaaaaaccugaucuggcucgugaagaaagguaauaguuacccaaaguuaagcaagucuuauauaaacgacaaagggaaggaaguacugguucuuuggggaauccaccaccccuccacuucagccgaucaacagagcuuguaccagaaugcggacgcauacguguucgucggcaccagucgcuauucuaaaaaguuuaaaccugagauugccauccgaccaaaggugcgugaucaggagggcagaaugaacuacuauuggacacugguggaacccggggacaaaauuacuuucgaggcuaccggaaaucuagucguuccuagguacgccuuugcaauggaacggaacgcugguuccggcaucauaauuagcgauacaccagugcaugacugcaacaccacgugucaaacuccgaagggggccaucaauacaucgcuccccuuccagaacauucacccuaucaccaucggaaagugcccaaaauauguaaagucuacuaaacugcgccuugcgacaggccugagaaauauucccuccgugcagucaagggguuuguuuggggccauagcaggauucaucgagggcggcuggaccgggauggucgacggaugguacgguuaucaucaccagaacgaacaaggcaguggguacgcugccgaucucaagagcacgcagaaugcuauugacaaaaucaccaacaaggugaauagcguuauagagaagaugaacacacaguuuacugccgugggaaaagaguucaaucaccuggaaaagcggauugagaacuuaaauaaaaaggucgaugacggcuuccuggauaucuggaccuacaacgcagaacuccuugugcuguuggagaaugaacgcacacuagacuaucaugauucuaacguaaagaaucuguacgagaagguucgaagccagcucaagaacaacgccaaagagaugaagaaugguuguuuugaguucuaucacaaaugcgacaacacuuguauggagucagugaagaaugggaccuacgauuauccuaaauacagugaagaggcuaagcugaacagagaagagaucgacggcgucaaacuugaguccacaaggauuuaucaaauccuggcgauuuacagcaccguggcaucuucauugguccucgugguuagucugggagccauauccuuuuggaugugcuccaauggcucuuuacagugccggaucuguauuuga

SEQ ID NO: 128209 - RNA, 1701 nt, Artificial Sequence
  derived and/or modified sequence opt3 from hemagglutinin__InfluenzaA__ADO79928
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaagaacucagggagcagcugucaagcgugaguuccuucgaacgguuugagauuuucccgaagaccaacucuuggcccaaucacgauagcaacaaaggcgucacggccgcuuguccucaugccggugcaaaguccuuuuauaaaaaucugaucuggcucgugaagaaagggaacucauacccaaaguuaaguaagagcuauauaaaugacaaaggaaaggaaguacugguucuuuggggcauccaccaccccucuacuuccgcugaucaacagucauuguaccagaacgccgacgcguacguguucgucggcaccagcaaauauaguaagaaauuuaagccugagauugcaauccgcccaaaagugcgagaucaggaggggcguaugaauuacuauuggacacugguggaacccggagacaagauuacuuucgaggccaccgguaaccuagucguuccuagauacgcuuuugccauggaaaggaacgcaggcucugggaucauaauuuccgauacaccagugcaugacugcaauaccacgugucaaacuccgaagggagcuaucaacacaagccuccccuuccagaauauucacccuaucaccaucggcaaaugcccaaaguauguaaaaucgacuaagcugcggcuugccacaggucugcgcaacgugcccucuauucaguccagaggguuguuuggagcgauagccggcuucaucgagggcggguggaccggaauggucgacgguugguacggcuaucaucaccagaaugaacaagggucaggauacgcagcugaucucaaaaguacgcagaacgccauugacgagaucaccaauaaggugaacagcguuauagagaagaugaauacacaguuuacugcugugggcaaagaguucaaccaccuggagaagaggauugaaaauuuaaacaaaaaggucgaugacgguuuccuggauaucuggaccuacaaugccgagcuccuugugcuguuggaaaacgagcggacacuagacuaucaugauuccaauguaaagaaccuguacgagaagguucgcucucagcucaagaacaaugcaaaagaaaucgggaacggcuguuuugaguucuaucacaagugcgacaauacuuguauggaaagcgugaaaaacggaaccuacgauuauccuaaguacucagaggaagccaaacugaaucgagaggagauugacggcgucaaacuugaaaguacaagaaucuaucaaauucuggcuauauacuccaccguggcgagcucuuugguccucgugguuucacugggggcaaucaguuuuuggaugugcagcaacggauccuuacagugcaggauuuguaucuga

SEQ ID NO: 128210 - RNA, 1701 nt, Artificial Sequence
  derived and/or modified sequence opt3 from hemagglutinin__InfluenzaA__ADO79929
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaagaacucagggagcagcugucaagcgugaguuccuucgaacgguuugagauuuucccgaagaccucuagcuggcccaaccacgauuccaauaaaggcgucacggccgcuuguccucaugcaggggccaagucauuuuauaaaaaccugaucuggcucgugaagaaagggaauaguuacccaaaguuaagcaagucuuauauaaacgacaaaggaaaggaaguacugguucuuuggggcauccaccaccccuccacuucagcugaucaacagagcuuguaccagaaugccgacgcguacguguucgucggcaccagucgcuauucuaaaaaguuuaaaccugagauugcaauccgaccaaaggugcgugggcaggagggaagaaugaacuacuauuggacacugguggaacccggugauaaaauuacuuucgaggccaccggcaaucuagucguuccuagguacgcuuuugccauggaacggaacgcaggguccggaaucauaauuagcgacacaccagugcaugauugcaacaccacgugucaaacuccgaagggcgcuaucaauacaucgcuccccuuccagaacauucacccuaucaccaucgguaagugcccaaaauauguaaagucuacuaaacugcgccuugccacagggcugagaaauauucccuccauacagucaaggggauuguuuggcgcgaucgccggcuucauugaggguggauggaccgguaugguggacggcugguacggguaucaucaccagaacgaacaaggaaguggcuacgcagcugaccucaagagcacgcagaaugccaucgaugagauaaccaacaaagucaauuccgugauugagaagaugaacacacaguuuacugcuguugguaaggaguucaaucaccuggagaaacggaucgaaaacuuaaauaagaaaguggacgauggguuccuggacaucuggaccuacaacgccgagcuccuuguccuguuggaaaaugagcgcacacuagauuaucaugacucuaacgugaagaaucuguacgagaaaguacgaagccagcucaagaacaacgcaaaggaaauuggcaauggauguuuugaguucuaucacaaaugcgauaacacuuguauggaaucaguuaagaauggcaccuacgacuauccuaaauacagugaggaagccaagcugaacagagaggagaucgauggggugaaacuugaauccacaaggauuuaucaaauacuggcuaucuacagcaccgucgcgucuucauuggugcucgucgugagucugggagcaauuagcuuuuggaugugcuccaaugguucuuuacagugccggaucuguaucuga

SEQ ID NO: 128211 - RNA, 1701 nt, Artificial Sequence
  derived and/or modified sequence opt3 from hemagglutinin__InfluenzaA__ADO79930
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgacugacaaguggacaugcuauccaggagauuuuaucgacuacgaagaacucagggagcagcugucaagcgugaguuccuucgaacgguuugagauuuucccgaagaccucuagcuggcccaaccacgauuccaauaaaggcgucacggccgcuuguccucaugccggugcaaagucauuuuauaaaaaccugaucuggcucgugaagaaagggaauaguuacccaaaguuaagcaagucuuauauaaacgacaaaggaaaggaaguacugguucuuuggggcauccaccaccccuccacuucagcugaucaacagagcuuguaccagaaugccgacgcguacguguucgucggcaccagucgcuauucuaaaaaguuuaaaccugagauugcaauccgaccaaaggugcgugauagagaggggaggaugaacuacuauuggacacugguggaacccggagacaaaauuacuuucgaggccaccgguaaucuagucguuccucgguacgcuuuugccauggaacgcaacgcaggcuccgggaucauaauuagcgauacaccagugcauaacugcaauaccacgugucagacuccgaagggagcuaucaacacaucgcuccccuuccaaaauauucacccuaucaccaucggcaagugcccaaaauauguaaagucuacuaaacugagacuugccacaggucugaggaacgugcccuccauucagucacggggguuguuuggagcgauagccggcuucaucgagggcggguggaccggaauggucgacgguugguacggcuaucaucaccagaaugaacaggggaguggauacgcagcugaccucaagagcacgcaaaacgccauugaugagaucaccaauaaagugaacuccguuauagagaagaugaauacacaguuuacugcugugggcaaggaguucaaccaccuggagaaacgcauugaaaauuuaaacaagaaagucgacgaugguuuccuggacaucuggaccuacaaugccgagcuccuugugcuguuggaaaacgagcgaacacuagauuaucaugacucuaauguaaagaaccuguacgagaaaguuagaagccagcucaagaacaaugcaaaggaaaucgggaacggcuguuuugaguucuaucacaaaugcgauaauacuuguauggaaucagugaagaacggaaccuacgacuauccuaaauacagugaggaagccaagcugaauagggaggagauugauggcgucaaacuugaauccacacggaucuaucagauucuggcuauauacagcaccguggcgucuucauugguccucgugguuagucugggggcaaucagcuuuuggaugugcuccaacggaucuuuacaaugccguauuuguaucuga

SEQ ID NO: 128212 - RNA, 1701 nt, Artificial Sequence
  derived and/or modified sequence opt3 from hemagglutinin__InfluenzaA__ADO84715
augaaggccauccuggugguccuccuuuacaccuucgcuacagcaaacgccggcacucugugcauuggguaucacgcgaauaacagcacggacaccguugauacaguguuggagaaaaauguaacugugacccauuccgucaacuuacuggaagacaagcacaauggaaaacuauguaagcucagagguguggcuccccugcaucuuggcaaaugcaacauagccggguggauccugggaaauccugagugugaaucuuugucaacagcaaguagcugguccuacauuguugagaccuuuucuucggauaacggcacuugcuauccaggugacuucaucgauuacgaagaacucagggagcagcugucaagcgugaguuccuuugaacgguucgagauuuuuccgaagacaucuagcuggcccaaucacgacuccaacaagggggucaccgccgcuuguccucaugcaggagccaaaucauucuauaagaaucugaucuggcucgugaaaaagggcaacaguuacccaaaauuaagcaagucuuauauaaaugauaagggcaaagaaguacugguucuuugggggauccaccaccccuccacgucagcugaccaacagagcuuguaccagaacgccgaugcguacguguuugucggaaccagucgcuauucuaagaaauucaagccugagauugcaauccgaccaaaagugcgugaccaggaggguagaaugaauuacuauuggacucugguggaacccggcgauaagauuacauuugaggccacugggaaccuagucguuccuagguacgcuuucgccauggaacggaacgcaggauccggcaucauaauuagcgacaccccagugcaugauugcaauacaaccugucaaacgccgaaaggugcuaucaacacuucgcuccccuuucagaauauucacccuaucacaaucgggaagugcccaaaguauguaaaaucuaccaagcugcgccuugccacuggacugagaaacgugcccuccauucagucaaggggcuuguucggcgcgauagccggguuuaucgagggagguuggacaggcauggucgacgggugguacggauaucaucaccagaaugaacaaggcagugguuacgcagcugaccucaaaagcacccagaacgccauugaugagaucacgaauaaggugaacuccguuauagagaaaaugaauacccaguucacagcuguggggaaggaguucaaccaccuggagaagcggauugaaaauuuaaacaaaaaggucgacgauggcuuucuggacaucuggacuuacaaugccgagcuccuugugcuguuggaaaacgagcgcacccuagauuaucaugacucuaauguaaagaaccuguacgagaagguucgaagccagcucaaaaacaaugcaaaggaaaucggaaacggcuguuucgaguuuuaucacaagugcgauaauacauguauggaaucagugaaaaacgggacuuacgacuauccuaaguacagugaggaagccaaacugaauagagaggagauugauggagucaaacuugaauccaccaggaucuaucaaauucuggcuauauacagcacaguggcgucuucauugguccucgugguuagucugggugcaaucagcuucuggaugugcuccaacggcucuuuacagugccggauuuguaucuga

SEQ ID NO: 128213 - RNA, 1701 nt, Artificial Sequence; identical to SEQ ID NO: 124865
  derived and/or modified sequence opt3 from hemagglutinin__InfluenzaA__ADP95341

SEQ ID NO: 128214 - RNA, 1701 nt, Artificial Sequence; identical to SEQ ID NO: 124672
  derived and/or modified sequence opt3 from hemagglutinin__InfluenzaA__ADP95351

SEQ ID NO: 128215 - RNA, 1701 nt, Artificial Sequence; identical to SEQ ID NO: 124672
  derived and/or modified sequence opt3 from hemagglutinin__InfluenzaA__ADP95361

SEQ ID NO: 128216 - RNA, 1701 nt, Artificial Sequence; identical to SEQ ID NO: 124672
  derived and/or modified sequence opt3 from hemagglutinin__InfluenzaA__ADP95371

SEQ ID NO: 128217 - RNA, 1701 nt, Artificial Sequence; identical to SEQ ID NO: 124672
  derived and/or modified sequence opt3 from hemagglutinin__InfluenzaA__ADP95381

SEQ ID NO: 128218 - RNA, 1701 nt, Artificial Sequence; identical to SEQ ID NO: 124672
  derived and/or modified sequence opt3 from hemagglutinin__InfluenzaA__ADP95391

SEQ ID NO: 128219 - RNA, 1701 nt, Artificial Sequence; identical to SEQ ID NO: 124927
  derived and/or modified sequence opt3 from hemagglutinin__InfluenzaA__ADQ28007

SEQ ID NO: 128220 - RNA, 1701 nt, Artificial Sequence; identical to SEQ ID NO: 124685
  derived and/or modified sequence opt3 from hemagglutinin__InfluenzaA__ADQ28008

SEQ ID NO: 128221 - RNA, 1701 nt, Artificial Sequence; identical to SEQ ID NO: 126536
  derived and/or modified sequence opt3 from hemagglutinin__InfluenzaA__ADQ28009

SEQ ID NO: 128222 - RNA, 1701 nt, Artificial Sequence
  derived and/or modified sequence opt3 from hemagglutinin__InfluenzaA__ADQ28010
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagagccugaucuggcucgugaaaaagggaaacucuuacccaaaauuauccaagucauauauaaaugauaagggcaaagaaguacugguucuuuggggcauccaccaccccagcacgagugcugaccaacagucuuuguaccagaacgccgaugcguacguguucgucgggacuucccgcuauagcaagaaauuuaagccugagauugcaauccgaccaaaagugcgugaccaggagggaagaaugaauuacuauuggacccugguggaacccggugauaagauuacauucgaggccacuggcaaccuagucguuccuagguacgcuuuugccauggaacggaacgcagggucgggaaucauaauuucugacaccccagugcaugauugcaauacaaccugucaaacgccgaaaggcgcuaucaacacuucccuccccuuccagaauauucacccuaucacaaucgguaagugcccaaaguauguaaaaucaaccaagcugcgccuugccacugggcugagaaacgugcccaguauucagagcaggggauuguuuggcgcgauagccggcuucaucgaagggggauggacagguauggucgacggcugguacggguaucaucaccagaaugaacaaggauccggcuacgcagcugaccucaaaucuacccagaacgccauugaugagaucacgaauaaggugaacagcguuauagagaaaaugaauacccaguuuacagcuguggguaaggaguucaaccaccuggaaaagcggauugaaaauuuaaacaaaaaggucgacgauggguuccuggacaucuggacuuacaaugccgagcuccuugugcuguuggaaaacgagcgcacccuagauuaucaugacucaaauguaaagaaccuguacgagaagguucgaagucagcucaaaaacaaugcaaaggaaaucggcaacggauguuuugaguucuaucacaagugcgauaauacauguauggaauccgugaaaaacggcacuuacgacuauccuaaguacagcgaggaagccaaacugaauagagaggagauugauggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 128223 - RNA, 1701 nt, Artificial Sequence; identical to SEQ ID NO: 124685
  derived and/or modified sequence opt3 from hemagglutinin__InfluenzaA__ADQ28011

SEQ ID NO: 128224 - RNA, 1701 nt, Artificial Sequence; identical to SEQ ID NO: 124685
  derived and/or modified sequence opt3 from hemagglutinin__InfluenzaA__ADQ28012

SEQ ID NO: 128225 - RNA, 1701 nt, Artificial Sequence; identical to SEQ ID NO: 124685
  derived and/or modified sequence opt3 from hemagglutinin__InfluenzaA__ADQ28013

SEQ ID NO: 128226 - RNA, 1701 nt, Artificial Sequence; identical to SEQ ID NO: 124927
  derived and/or modified sequence opt3 from hemagglutinin__InfluenzaA__ADQ28014

SEQ ID NO: 128227 - RNA, 1701 nt, Artificial Sequence; identical to SEQ ID NO: 124927
  derived and/or modified sequence opt3 from hemagglutinin__InfluenzaA__ADQ28015

SEQ ID NO: 128228 - RNA, 1701 nt, Artificial Sequence; identical to SEQ ID NO: 124685
  derived and/or modified sequence opt3 from hemagglutinin__InfluenzaA__ADQ28016

SEQ ID NO: 128229 - RNA, 1701 nt, Artificial Sequence; identical to SEQ ID NO: 124685
  derived and/or modified sequence opt3 from hemagglutinin__InfluenzaA__ADQ28017

SEQ ID NO: 128230 - RNA, 1701 nt, Artificial Sequence; identical to SEQ ID NO: 126931
  derived and/or modified sequence opt3 from hemagglutinin__InfluenzaA__ADQ28018

SEQ ID NO: 128231 - RNA, 1701 nt, Artificial Sequence; identical to SEQ ID NO: 124927
  derived and/or modified sequence opt3 from hemagglutinin__InfluenzaA__ADQ28019

SEQ ID NO: 128232 - RNA, 1701 nt, Artificial Sequence
  derived and/or modified sequence opt3 from hemagglutinin__InfluenzaA__ADQ28020
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaagcaggggccaagaguuuuuauaaaaaucugaucuggcucgugaagaaaggaaacagcuacccaaaguuaucuaaauccuauauaaaugacaagggcaaggagguacugguucuuuggggcauccaucaccccucaacgagcgcugaucagcagaguuuguaccagaacgccgacgcguacguguucgucgggucuucccgcuauagcaaaaaguuuaaaccugagauugcaauccgaccaaaggugcgugaucaagaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcacgacugcaauaccacaugucagaccccgaagggcgcuaucaacacgucccuccccuuccauaauauucacccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccagaaugagcaaggauccggcuacgcagcugaucucaagucuacacagaacgccauugacgagaucaccaauaaagugaacagcguuauagaaaagaugaauacgcaguuuaccgcuguggguaaagaguucaaccaccuggaaaagcggauugagaauuuaaacaagaaagucgaugacggguuccuggauaucuggacauacaaugccgaacuccuugugcuguuggagaacgagcgcacucuagacuaucaugauucaaauguaaagaaccuguacgaaaaaguucgaagucagcucaagaacaaugcaaaagagaucggcaacggauguuuugaguucuaucacaagugcgacaauaccuguauggaauccgugaagaacggcacauacgauuauccuaaauacagcgaagaggccaagcugaauagagaggaaauugacggggucaaacuugagucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 128233 - RNA, 1701 nt, Artificial Sequence; identical to SEQ ID NO: 125879
  derived and/or modified sequence opt3 from hemagglutinin__InfluenzaA__ADQ28021

SEQ ID NO: 128234 - RNA, 1701 nt, Artificial Sequence
  derived and/or modified sequence opt3 from hemagglutinin__InfluenzaA__ADQ28022
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcguggacaggaggguagaaugaacuacuauuggacccugguggaacccggcgacaagauuacauucgaggccacugggaaccuagucguuccuagguacgcuuuugccauggaacggaaugcaggaagcggcaucauaauuucggauaccccagugcaugacugcaacacaaccugucaaacgccgaaaggugcuaucaauacuucucuccccuuccagaacauucacccuaucacaaucgggaagugcccaaaguauguaaaauccaccaagcugcgccuugccacuggacugagaaaugugcccucaauucagaguaggggcuuguuuggcgcgauagccggguucaucgagggagguuggacaggcauggucgaugggugguacggauaucaucaccagaacgaacaaggcagcgguuacgcagcugaccucaaauccacccagaaugccauugacgagaucacgaacaagguaaauucuguuauagagaaaaugaacacccaguuuacagcuguggggaaggaguucaaucaccuggagaagcggauugaaaacuuaaauaaaaaggucgaugacggcuuccuggauaucuggacuuacaacgccgagcuccuugugcuguuggaaaaugagcgcacccuagacuaucaugauagcaacgugaaaaaccuguacgagaagguucgaucacagcucaaaaauaacgcaaaggaaaucggaaauggcuguuuugaguucuaucacaagugcgacaacacauguauggaaagugugaaaaaugggacuuacgauuauccuaaguacuccgaggaagccaaacugaacagagaggagauugacggagucaaacuugaaagcaccaggaucuaucaaauucuggcuauauacucuacaguggcgucaaguuugguccucgugguuagccugggugcaaucuccuuuuggaugugcucuaauggcucguuacagugccggauuuguaucuga

SEQ ID NO: 128235 - RNA, 1701 nt, Artificial Sequence; identical to SEQ ID NO: 124685
  derived and/or modified sequence opt3 from hemagglutinin__InfluenzaA__ADQ28023

SEQ ID NO: 128236 - RNA, 1701 nt, Artificial Sequence; identical to SEQ ID NO: 124927
  derived and/or modified sequence opt3 from hemagglutinin__InfluenzaA__ADQ28024

SEQ ID NO: 128237 - RNA, 1701 nt, Artificial Sequence; identical to SEQ ID NO: 124927
  derived and/or modified sequence opt3 from hemagglutinin__InfluenzaA__ADQ28025

SEQ ID NO: 128238 - RNA, 1701 nt, Artificial Sequence; identical to SEQ ID NO: 125430
  derived and/or modified sequence opt3 from hemagglutinin__InfluenzaA__ADQ28028

SEQ ID NO: 128239 - RNA, 1701 nt, Artificial Sequence; identical to SEQ ID NO: 126910
  derived and/or modified sequence opt3 from hemagglutinin__InfluenzaA__ADQ28029

SEQ ID NO: 128240 - RNA, 1701 nt, Artificial Sequence
  derived and/or modified sequence opt3 from hemagglutinin__InfluenzaA__ADQ28030
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaaggguaucaccgccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaacgagcgcugaccaacagaguuuguaccagaaugccgaugcguacguuuucguggggacuucucgcuauuccaagaaauuuaagccugagaucgcaauucgaccaaaaguccgugaccaggagggaagaaugaacuacuauuggacccugguggaacccggugauaagaucacauucgaggccacuggcaaccuaguggucccuagguacgcuuuugccauggaacggaaugcagggagcggaauaauuaucucggacaccccaguucaugauugcaacacaaccugucaaacgccgaaaggcgcuauuaauacuucucuccccuuccagaacauccacccuaucacaauugguaagugcccaaaguaugugaaauccaccaagcugcgccuugccacugggcugagaaauguacccucaauacagaguaggggauuguuuggcgcgaucgccggcuucauugaagggggauggacagguaugguggacggcugguacggguaucaucaccagaacgaacaaggaagcggcuacgcagcugaccucaaauccacccagaaugccaucgaugagauaacgaacaaggucaauucugugauugagaaaaugaacacccaguuuacagcuguugguaaggaguucaaucaccuggaaaagcggaucgaaaacuuaaauaaaaagguggacgauggguuccuggacaucuggacuuacaacgccgagcuccuuguccuguuggaaaaugagcgcacccuagauuaucaugacagcaacgugaaaaaccuguacgagaagguacgaucacagcucaaaaauaacgcaaaggaaauuggcaauggauguuuugaguucuaucacaagugcgauaacacauguauggaaaguguuaaaaauggcacuuacgacuauccuaaguacuccgaggaagccaaacugaacagagaggagaucgauggggugaaacuugaaagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 128241 - RNA, 1701 nt, Artificial Sequence; identical to SEQ ID NO: 125879
  derived and/or modified sequence opt3 from hemagglutinin__InfluenzaA__ADQ28031

SEQ ID NO: 128242 - RNA, 1701 nt, Artificial Sequence; identical to SEQ ID NO: 124927
  derived and/or modified sequence opt3 from hemagglutinin__InfluenzaA__ADQ28032

SEQ ID NO: 128243 - RNA, 1701 nt, Artificial Sequence
  derived and/or modified sequence opt3 from hemagglutinin__InfluenzaA__ADQ28034
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcguggacaggaggguagaaugaacuacuauuggaccauuguggaacccggcgacaagaucacauucgaggccacugggaaccuggucguuccuagguacgcuuuugccauggaacggaaugcaggaagcggcauaauuaucucggauaccccagugcaugacugcaacacaaccugucaaacgccgaaaggugcuauuaauacuucucuacccuuccagaacauccacccuaucacaauugggaagugcccaaaguauguaaaauccaccaagcuccgccuggccacuggacuuagaaaugugcccucaauacagaguaggggccuguuuggcgcgaucgccggguucauugagggagguuggacaggcauggucgaugggugguacggauaucaucaccagaacgaacaaggcagcgguuacgcagcugacuugaaauccacccagaaugccaucgacgagauaacgaacaagguuaauucugugauugagaaaaugaacacccaguuuacagcuguggggaaggaguucaaucaccucgagaagcggaucgaaaaccugaaucgcaaagucgaugacggcuucuuagauaucuggacuuacaacgccgagcugcucgugcuucuggaaaaugagcgaaccuuggacuaucaugauagcaacguaaagaaccuauacgagaaaguuagaucacagcugaagaauaacgcaaaagaaauuggaaauggcuguuuugaguucuaucacaagugcgacaacacauguauggaaagugugaagaaugggacuuacgauuauccuaaauacuccgaggaagccaagcucaacagggaggagaucgacggagucaaacuggaaagcacccggauuuaucaaauacuugcuaucuacucuacaguggcgucaagucuggucuuggugguuagccucggugcaauuuccuuuuggaugugcucuaauggcucgcugcagugccguaucuguaucuga

SEQ ID NO: 128244 - RNA, 1701 nt, Artificial Sequence
  derived and/or modified sequence opt3 from hemagglutinin__InfluenzaA__ADQ28035
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguagacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagaggacaggaggguaggaugaauuacuauuggacccugguggaacccggcgauaaaauuacauucgaggccacugggaaccuagucguuccucgguacgcuuuugccauggaacgcaacgcaggaagcggcaucauaauuucggacaccccagugcaugauugcaauacaaccugucaaacgccgaagggugcuaucaacacuucucuccccuuccagaauauucacccuaucacaaucgggaaaugcccaaaguauguaaaguccaccaaacugagacuugccacuggacugaggaacgugcccucaauucagagucggggcuuguuuggcgcgauagccggguucaucgagggagguuggacaggcauggucgacgggugguacggauaucaucaccagaaugaacaaggcagcgguuacgcagcugaccucaaguccacccagaacgccauugaugagaucacgaauaaagugaacucuguuauagagaagaugaauacccaguuuacagcuguggggaaagaguucaaccaccuggagaagcgcauugaaaauuuaaacaagaaagucgacgauggcuuccuggacaucuggacuuacaaugccgagcuccuugugcuguuggaaaacgagcgaacccuagauuaucaugacagcaauguaaagaaccuguacgagaaaguuagaucacagcucaagaacaaugcaaaagaaaucggaaacggcuguuuugaguucuaucacaagugcgauaauacauguauggaaagugugaagaacgggacuuacgacuauccuaaauacuccgaggaagccaagcugaauagggaggagauugauggagucaaacuugaaagcacccggaucuaucaaauucuggcuauauacucuacaguggcgucaaguuugguccucgugguuagccugggugcaaucuccuuuuggaugugcucuaacggcucguuacagugccguauuuguaucuga

SEQ ID NO: 128245 - RNA, 1701 nt, Artificial Sequence; identical to SEQ ID NO: 124685
  derived and/or modified sequence opt3 from hemagglutinin__InfluenzaA__ADQ28036

SEQ ID NO: 128246 - RNA, 1701 nt, Artificial Sequence; identical to SEQ ID NO: 124685
  derived and/or modified sequence opt3 from hemagglutinin__InfluenzaA__ADQ28037

SEQ ID NO: 128247 - RNA, 1701 nt, Artificial Sequence; identical to SEQ ID NO: 124927
  derived and/or modified sequence opt3 from hemagglutinin__InfluenzaA__ADQ28038

SEQ ID NO: 128248 - RNA, 1701 nt, Artificial Sequence; identical to SEQ ID NO: 124685
  derived and/or modified sequence opt3 from hemagglutinin__InfluenzaA__ADQ28039

SEQ ID NO: 128249 - RNA, 1701 nt, Artificial Sequence; identical to SEQ ID NO: 124927
  derived and/or modified sequence opt3 from hemagglutinin__InfluenzaA__ADQ28040

SEQ ID NO: 128250 - RNA, 1701 nt, Artificial Sequence; identical to SEQ ID NO: 124927
  derived and/or modified sequence opt3 from hemagglutinin__InfluenzaA__ADQ28041

SEQ ID NO: 128251 - RNA, 1701 nt, Artificial Sequence
  derived and/or modified sequence opt3 from hemagglutinin__InfluenzaA__ADQ28043
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugacggggcaaagaguuuuuauaaaaaucugaucuggcucgugaagaaaggaaacagcuacccaaaguuaucuaaauccuauauaaaugauaagggcaaggagguacugguucuuuggggcauccaccaccccucaacgagcgccgaccaacagaguuuguaccagaacgcugaugccuacguguucgucgggucuucccgcuauagcaaaaaguuuaaaccugagauugcgauccgaccaaaggugcgugaccaggaaggaagaaugaauuacuauuggacucugguggagcccggugauaaaauuaccuucgaagcaacaggcaaccuagucguuccuagguacgccuuugcuauggagcggaacgccgggucgggaaucauaauuucugacacuccagugcaugacugcaauaccacaugucaaaccccgaagggcgcaaucaacacgucccuccccuuccacaauauucauccuaucacuaucgguaaaugcccaaaguauguaaagucaacaaaacugcgccuugcuaccgggcugagaaacgugcccaguauucagagcaggggauuguuuggcgccauagcgggcuucaucgaagggggauggacugguauggucgauggcugguacggguaucaccaccagaaugagcagggauccggcuacgccgcagaccucaagucuacacaaaacgcuauugaugagaucaccaauaaagugaacagcguuauagaaaagaugaauacgcaguuuaccgccguggguaaagaguucaaccaucuggaaaagcggauugagaauuuaaacaagaaagucgacgauggguuccuggacaucuggacauacaaugcugaacuccuugugcuguuggagaacgagcgcacucuagauuaucacgacucaaauguaaagaaccuguacgaaaaaguucgaagucagcucaagaacaaugccaaagagaucggcaacggauguuuugaguucuaucauaagugcgauaauaccuguauggaauccgugaagaacggcacauacgacuauccuaaauacagcgaagaggcaaagcugaauagagaggaaauugauggggucaaacuugagucuacuaggaucuaucagauucuggccauauacucaaccguggcuaguagcuugguccucgugguuucccugggagcgaucucuuuuuggaugugcucgaacgguagcuuacaaugccggauuuguaucuga

SEQ ID NO: 128252 - RNA, 1701 nt, Artificial Sequence; identical to SEQ ID NO: 124927
  derived and/or modified sequence opt3 from hemagglutinin__InfluenzaA__ADQ28044

SEQ ID NO: 128253 - RNA, 1701 nt, Artificial Sequence
  derived and/or modified sequence opt3 from hemagglutinin__InfluenzaA__ADQ28045
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugaucaggagggaagaaugaauuacuauuggacccugguggaaccaggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguuaaaaaccuguacgagaagguacgaaaccagcucaaaaauaacgcaaaggaaaucggcaauggauguuuugaguucuaucacaagugcgacaacacauguauggaaagugugaaaaauggcacuuacgauuaucccaaguacuccgaggaagccaaacugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128254 - RNA, 1701 nt, Artificial Sequence; identical to SEQ ID NO: 125155
  derived and/or modified sequence opt3 from hemagglutinin__InfluenzaA__ADQ28047

SEQ ID NO: 128255 - RNA, 1701 nt, Artificial Sequence; identical to SEQ ID NO: 124685
  derived and/or modified sequence opt3 from hemagglutinin__InfluenzaA__ADQ28048

SEQ ID NO: 128256 - RNA, 1701 nt, Artificial Sequence; identical to SEQ ID NO: 124927
  derived and/or modified sequence opt3 from hemagglutinin__InfluenzaA__ADQ28049

SEQ ID NO: 128257 - RNA, 1701 nt, Artificial Sequence; identical to SEQ ID NO: 124685
  derived and/or modified sequence opt3 from hemagglutinin__InfluenzaA__ADQ28050

SEQ ID NO: 128258 - RNA, 1701 nt, Artificial Sequence
  derived and/or modified sequence opt3 from hemagglutinin__InfluenzaA__ADQ28051
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucaacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 128259 - RNA, 1701 nt, Artificial Sequence; identical to SEQ ID NO: 124685
  derived and/or modified sequence opt3 from hemagglutinin__InfluenzaA__ADQ28053

SEQ ID NO: 128260 - RNA, 1701 nt, Artificial Sequence; identical to SEQ ID NO: 124927
  derived and/or modified sequence opt3 from hemagglutinin__InfluenzaA__ADQ28055

SEQ ID NO: 128261 - RNA, 1701 nt, Artificial Sequence
  derived and/or modified sequence opt3 from hemagglutinin__InfluenzaA__ADQ28056
auggaggccauccuggugguccuccuuuacaccuucgcuacagcagacgccgauacucugugcauuggcuaucacgcgaacaauagcacggacaccguugauacaguguuggaaaagaacguaacugugacccauuccgucaauuuacuggaggacaaacacaacgggaagcuauguaaacucagaggaguggcuccccugcaucuugguaagugcaauauagccggcuggauccuggggaacccugaaugugagucuuugucaacagcaaguagcugguccuacauuguugaaaccucuucgucagauaauggaacuugcuauccaggcgacuuuaucgauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggucuucccgcuauagcaaaaaguuuaaaccugagauugcaauccgaccaaaggugcgugaccaggaaggaagaaugaacuacuauuggacucugguggagcccggugauaaaauuaccuucgaagccacaggcaaucuagucguuccuagguacgcuuuugccauggagcggaacgcagggucgggaaucauaauuucugacacuccagugcaugacugcaacaccacaugucaaaccccgaagggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgauggcugguacggguaucaccaccagaacgagcagggauccggcuacgcagcugaccucaagucuacacaaaaugccauugaugagaucaccaacaaagugaauagcguuauagaaaagaugaacacgcaguuuaccgcuguggguaaagaguucaaucaucuggaaaagcggauugagaacuuaaauaagaaagucgacgauggguuccuggacaucuggacauacaacgccgaacuccuugugcuguuggagaaugagcgcacucuagauuaucacgacucaaacguaaagaaucuguacgaaaaaguucgaagucagcucaagaacaacgcaaaagagaucggcaauggauguuuugaguucuaucauaagugcgauaacaccuguauggaauccgugaagaauggcacauacgacuauccuaaauacagcgaagaggccaagcugaacagagaggaaauugauggggucaaacuugagucuacuaggaucuaucagauucuggcuauauacucaaccguggcgaguagcuugguccucgugguuucccugggagcaaucucuuuuuggaugugcucgaaugguagcuuacaaugccggauuuguaucuga

SEQ ID NO: 128262 - RNA, 1701 nt, Artificial Sequence; identical to SEQ ID NO: 124685
  derived and/or modified sequence opt3 from hemagglutinin__InfluenzaA__ADQ28057

SEQ ID NO: 128263 - RNA, 1701 nt, Artificial Sequence; identical to SEQ ID NO: 124685
  derived and/or modified sequence opt3 from hemagglutinin__InfluenzaA__ADQ28058

SEQ ID NO: 128264 - RNA, 1701 nt, Artificial Sequence
  derived and/or modified sequence opt3 from hemagglutinin__InfluenzaA__ADQ28059
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucgacuacgaggagcugagggagcagcugagcaguguguccucuuuugaacgguucgagauuuuuccgaagacaagcuccuggcccaaucacgauucaaacaagggugucaccgccgcuuguccucaugcaggggccaaaaguuucuauaagaaucucaucugguuagugaaaaagggaaacagcuacccaaaacugucuaaguccuauauaaaugacaagggcaaagaaguacuuguuuuguggggcauccaccaccccucaacgagcgcugaucaacagagucuguaccagaacgccgacgcguacguguuugucgggacuucuaaguauuccaaaaaguucaaaccugagauugcaauccgcccaaaggugcgagaucaggagggacguaugaauuacuauuggacccuaguggaacccggugacaaaauuacauuugaggccacuggcaaccucgucguuccuagauacgcuuucgccauggaaaggaacgcagggagcggaaucauaauuucggauaccccagugcaugacugcaauacaaccugucaaacgccgaagggcgcuaucaacacuucucugcccuuucagaauauucacccuaucacaaucgguaagugcccaaaauauguaaaguccaccaaacuucggcuggccacuggguugcgcaacgugcccucaauucagaguagaggacucuucggcgcgauagccggcuuuaucgaagggggauggacagguauggucgacggcugguacggguaucaucaccagaaugaacaaggaagcggcuacgcagcugaucugaaguccacccagaacgccauugacgagaucacgaauaaagugaacucuguuauagagaagaugaauacccaguucacagcuguggguaaggaauuuaaccacuuagagaaaaggauugaaaaucugaacaagaaagucgaugacggguuccucgauaucuggacuuacaaugccgagcuucugguguugcuagaaaacgagcggacccuggacuaucaugauagcaauguaaagaaccucuacgagaaaguucgcucacagcugaagaacaaugcaaaggaaaucggcaacggauguuucgaguuuuaucacaaaugcgacaauacauguauggaaagugugaagaacggcacuuacgauuauccuaaauacuccgaggaagccaaacuuaaucgagaggagauugacggggucaagcuggaaagcaccagaaucuaucaaauuuuggcuauauacucuacaguggcgucaagucucguccuggugguuagcuuaggagcaaucuccuucuggaugugcucuaacgguucgcugcagugcaggauuuguaucuga

SEQ ID NO: 128265 - RNA, 1701 nt, Artificial Sequence; identical to SEQ ID NO: 124685
  derived and/or modified sequence opt3 from hemagglutinin__InfluenzaA__ADQ28060

SEQ ID NO: 128266 - RNA, 1701 nt, Artificial Sequence
  derived and/or modified sequence opt3 from hemagglutinin__InfluenzaA__ADQ28061
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaggugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcgaauguguucgucgggacuucucgauacuccaaaaaguuuaaaccugagauugcaauccguccaaaggugagagaucaggagggaaggaugaacuauuacuggacccugguggaacccggugacaaaauuacauucgaggccacuggcaaccuagucguuccucgguaugcuuuugccauggaacgcaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguacguaaaguccaccaaacugagacuugccacugggcugaggaaugugcccucaauucagagucggggauuguuuggcgcgauagccggcuucaucgaagggggauggacagguauggucgacggcugguauggguaccaucaccagaacgaacaaggaagcggcuaugcagcugaucucaaguccacccagaaugccauugacgagaucacgaacaaaguuaauucugugauagagaagaugaacacccaguuuacagcuguggguaaagaguucaaucaccuggaaaagcgcauugaaaacuuaaauaagaaagucgaugacggguuccuggauaucuggacuuacaacgccgagcuccuugugcuguuggaaaaugagcgaacccuagacuaccaugauagcaacguaaagaaccuguaugagaaaguuagaucacagcucaagaauaacgcaaaagaaaucggcaauggauguuuugaguucuaccacaagugcgacaacacauguauggaaagugugaagaauggcacuuaugauuacccuaaauauuccgaggaagccaagcugaacagggaggagauugacggggucaaacuugaaagcacccggaucuaccaaauucuggcuauauauucuacaguggcgucaaguuugguccucgugguuagccugggagcaaucuccuuuuggaugugcucuaaugguucguuacagugccguauuuguaucuga

SEQ ID NO: 128267 - RNA, 1701 nt, Artificial Sequence
  derived and/or modified sequence opt3 from hemagglutinin__InfluenzaA__ADQ28063
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcguaaccaggagggaagaaugaacuaccauuggacccuggugaagcccggugacaaaauuacauucgaagccacuggcaaucuagucguuccuagguaugcuuuugccguggagcggaacgcagggagcggaaucauaauuucggauaccccaguacacgacugcaauacaaccugucaaacgccgaagggcgcuaucaacacuucucuccccuuccagaauauucauccuaucacaaucgguaagugcccaaaauacgugaaguccaccaaacugcgccuugccacugggcugagaaacguccccucaauucagaguaggggauuguuuggcgcgauagccggcuucaucgaagggggauggacagguaugguggauggcugguauggguaccaccaccagaaugagcaaggaagcggcuaugcagcugaccucaaguccacccagaacgccauugacgaaaucacgaauaaaguuaacucugugauagagaagaugaauacccaguuuacagcugucgguaaggaguucaaccaucuggaaaaacggauugagaauuuaaacaagaaaguggaugacggguuccuggauaucuggacuuacaaugccgaacuccuuguacuguuggagaacgaacgcacccuagacuaccacgauagcaacguuaagaaucuguaugagaaagugcgaucacagcucaagaacaaugcaaaggagaucggcaacggauguuuugaguucuaccauaaaugcgacaauacauguauggagagugucaagaacggcacuuaugauuacccuaaauauuccgaagaggccaagcugaauagagaagagauugacggggugaaacuugagagcaccaggaucuaccaaauucuggcuauauauucuacagucgcgucaaguuuggugcucguugugagccugggagcaaucuccuuuuggaugugcucuaacgguucguuacagugccggauuuguaucuga

SEQ ID NO: 128268 - RNA, 1701 nt, Artificial Sequence; identical to SEQ ID NO: 125433
  derived and/or modified sequence opt3 from hemagglutinin__InfluenzaA__ADQ28064

SEQ ID NO: 128269 - RNA, 1701 nt, Artificial Sequence
  derived and/or modified sequence opt3 from hemagglutinin__InfluenzaA__ADQ28065
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugggcaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacacccaagugcaugauugcaauacaaccugucagacgccaaaaggugcuaucaacacuucucucccguuccagaauauucaccccaucacaaucgggaagugcccuaaguauguaaaauccaccaagcugcgccuugccacuggacugagaaacgugccaucaauucagaguaggggcuuguuuggcgcgauagccggguucaucgagggagguuggacaggcauggucgacgggugguacggauaucaucaccaaaaugaacagggcagcgguuacgcagcugaccucaaauccacccagaacgccauugauaagaucacgaauaaagugaacucuguuauagagaagaugaauacccaguuuacagcuguggggaaggaguucaaccaccuggaaaaacggauugagaauuuaaacaagaaagucgacgauggcuuccuggacaucuggacuuacaaugccgaacuccuugugcuguuggagaacgaacgcacccuagauuaucaugacagcaauguaaagaaccuguacgagaaaguucgaucacaacucaagaacaaugcaaaggagaucggaaacggcuguuuugaguucuaucacaaaugcgauaauacauguauggagagugugaagaacgggacuuacgacuaucccaaauacuccgaagaggccaagcugaauagagaagagauugauggagucaaacuugagagcaccaggaucuaucagauucuggcuauauacucuacaguggcgucaaguuugguccucgugguuagccugggugcaaucuccuuuuggaugugcucuaacggcucguuacagugccggauuuguaucuga

SEQ ID NO: 128270 - RNA, 1701 nt, Artificial Sequence
  derived and/or modified sequence opt3 from hemagglutinin__InfluenzaA__ADQ28066
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccacgugugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaaaaugaauacccaguuuacagcuguggguaaggaguucaaccaccuggaaaagcgcauugagaauuuaaacaaaaaggucgaugacggguuccuggauaucuggacuuacaaugccgaacuccuugugcuguuggagaacgaacgaacccuagacuaucaugauagcaauguaaagaaccuguacgagaagguuagaucacagcucaaaaacaaugcaaaggagaucggcaacggauguuuugaguucuaucacaagugcgacaauacauguauggaaagugugaaaaacggcacuuacgauuauccuaaguacuccgaagaggccaaacugaauagggaagagauugacggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 128271 - RNA, 1701 nt, Artificial Sequence
  derived and/or modified sequence opt3 from hemagglutinin__InfluenzaA__ADQ28067
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauuaacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128272 - RNA, 1701 nt, Artificial Sequence
  derived and/or modified sequence opt3 from hemagglutinin__InfluenzaA__ADQ28068
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggaaaaaucuuuuuauaagaaccugaucuggcucgugaaaaagggaaauagcuacccaaaauuaucuaaguccuauauaaacgauaagggcaaagagguacugguucuuuggggcauccaccaccccucaacuagcgcagaccaacagaguuuguaccagaaugccgaugcuuacguguucgucgggaccucucgcuauuccaagaaauuuaagccugagauugccauccgaccaaaagugcgugaccaggaaggaagaaugaacuaccauuggacacuggugaagcccggugauaaaauuacuuucgaggcgaccggcaaccuagucguuccuagguaugcauuugccauggaacggaaugcugggagcggaaucauaauuucggacacaccagugcacgauugcaacaccacgugucaaacuccgaagggcgccaucaauacaucucuccccuuccagaacauucauccuaucaccaucgguaagugcccaaaauacguaaaguccacuaaacugcgccuugcaacagggcugagaaaugugcccucaauucagaguaggggauuguuuggcgcuauagccggcuucaucgaagggggauggaccgguauggucgacggcugguauggguaccaccaccagaacgaacaaggaagcggcuaugcggccgaccucaaguccacgcagaaugcaauugaugagaucaccaacaaagugaauaguguuauagagaagaugaacacacaguuuacugcuguggguaaggaguucaaucaucuggaaaaacggauugaaaacuuaaauaagaaagucgacgauggguuccuggacaucuggaccuacaacgccgagcuccuugugcuguuggaaaaugagcgcacacuagauuaccacgacagcaacguaaagaaccuguaugagaaaguucgaucacagcucaagaauaacgcuaaggaaaucggcaauggauguuuugaguucuaccauaaaugcgauaacacuuguauggaaagugugaagaauggcaccuaugacuacccuaaauauuccgaggaagccaagcugaacagagaggagauugauggggucaaacuugaaagcacaaggaucuaccaaauucuggcaauauauucuaccguggccucaaguuugguccucgugguuagccugggagcuaucuccuuuuggaugugcucuaaugguucguuacagugccggauuuguaucuga

SEQ ID NO: 128273 - RNA, 1701 nt, Artificial Sequence; identical to SEQ ID NO: 128271
  derived and/or modified sequence opt3 from hemagglutinin__InfluenzaA__ADQ28069

SEQ ID NO: 128274 - RNA, 1701 nt, Artificial Sequence
  derived and/or modified sequence opt3 from hemagglutinin__InfluenzaA__ADQ28070
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaagacagcucaagaacaaugcaaaggagaucggcaacggauguuuugaguucuaucacaaaugcgacaauacauguauggaaucagugaagaacggcacuuacgauuauccuaaauacagugaagaggccaagcugaauagggaagagauugacggggucaaacuugaguccacccggaucuaucaaauucuggcuauauacagcacaguggcgucuucauugguccucgugguuagucugggagcaaucagcuuuuggaugugcuccaacgguucuuuacagugccguauuuguaucuga

SEQ ID NO: 128275 - RNA, 1701 nt, Artificial Sequence
  derived and/or modified sequence opt3 from hemagglutinin__InfluenzaA__ADQ28071
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucgacuacgaggagcugagggagcagcugagcaguguguccucuuuugaacgguucgagauuuuuccgaagacaagcuccuggcccaaucacgauucaaacaagggugucaccgccgcuuguccucaugcaggggccaaaaguuucuauaagaaucucaucugguuagugaaaaagggaaacagcuacccaaaacugucuaaguccuauauaaaugacaagggcaaagaaguacuuguuuuguggggcauccaccaccccucaacgagcgcugaucaacagagucuguaccagaacgccgacgcguacguguuugucgggacuucucgcuauuccaagaaauucaagccugagauugcaauccgaccaaaagugcgugaucaggagggaagaaugaauuacuauuggacccuaguggaacccggugacaagauuacauuugaggccacuggcaaccucgucguuccuagguacgcuuucgccauggaacggaacgcagggagcggaaucauaauuucggauaccccagugcaugacugcaauacaaccugucaaacgccgaaaggcgcuaucaacacuucucugcccuuucagaauauucacccuaucacaaucgguaagugcccaaaguauguaaaauccaccaaacuucgccuggccacuggguugagaaacgugcccucaauucagaguaggggacucuucggcgcgauagccggcuuuaucgaagggggauggacagguauggucgacggcugguacggguaucaucaccagaaugaacaaggaagcggcuacgcagcugaucugaaguccacccagaacgccauugacaagaucacgaauaaagugaacucuguuauagagaagaugaauacccaguucacagcuguggguaaggaguuuaaccacuuagaaaaacggauugagaaucugaacaagaaagucgaugacggguuccucgauaucuggacuuacaaugccgaacuucugguguugcuagagaacgaacgcacccuggacuaucaugauagcaauguaaagaaccucuacgagaaaguucgaucacagcugaagaacaaugcaaaggagaucggcaacggauguuucgaauuuuaucacaaaugcgacaauacauguauggagagugugaagaacggcacuuacgauuauccuaaauacuccgaagaggccaaacuuaauagagaagagauugacggggucaagcuggagagcaccaggaucuaucaaauuuuggcuauauacucuacaguggcgucaagucucguccuggugguuagcuuaggagcaaucuccuucuggaugugcucuaacgguucgcugcagugccggauuuguaucuga

SEQ ID NO: 128276 - RNA, 1701 nt, Artificial Sequence; identical to SEQ ID NO: 125629
  derived and/or modified sequence opt3 from hemagglutinin__InfluenzaA__ADR32361

SEQ ID NO: 128277 - RNA, 1689 nt, Artificial Sequence
  derived and/or modified sequence opt3 from hemagglutinin__InfluenzaA__ADT78887
auggcccugaucuaccucauucuucuguucaccagcgugagaggcgaccagauaugcaucggguaucacgcuaacaauuccacagagaaggucgauacuauuuuggaaaggaacguuacggugacccaugcaaaagacaucuuagagaagacacacaauggaaaacuguguaagcuaaacgguauucccccucucgaacugggcgauugcucuaucgccggguggcuucugggaaauccagagugugaccgguugcuccgcguaccggaauggucauacauaauggagaaagagaaccccaaguauagucugugcuacccuggcagcuuuaaugauuaugaggaacugaagcaucucaucuccucugugaaacacuucgaaaaggucaaaauuuuaccaaaggacgguuggacucaacauaccacaaccgggggaucgcgagcgugugcugugucaggcaaccccagcuuuuuccguaauaugguuuggcugacuaaaaagggcccuaacuacccaguggccaaggggaguuauaauaacacauccggagagcagaugcuuaucauuugggguguccaccaccccaaugaugaggcagaacagagagccuuguaccagaaagugggcaccuacguaucugcuagcacguccacucugaacaagaggucaaccccugagaucgcagcccggccagaaguuaaugggcuaggaagucgcauggaguuuagcuggacacuccuggacaugugggauacuauaaacuucgaaucuaccggcaaccuuguggcuccggaguaugguuuuaaaauuuccaagagagggucaagcggagucaugaaaacagagggcacccuggaaaauugcgagacgaagugucaaacucccuugggcgccaucaacacaacccucccuuuccauaaugugcacccacugacuauuggggaaugccccaaauacgugaagagugagaaguuaguccuggcgacaggacucaggaacguuccucagaucgaaucucggggucuuuuuggcgcaaucgccggguucauugagggaggcuggcaggguaugguggacgggugguauggcuaccaucacuccaaugaucagggaagcggcuaugcugccgacaaagagucgacccaaaaggcauuugaugggauaacgaacaaaguaaauucugugaucgaaaagaugaacacccaguucgaggcugucggaaaagaauuuuccaaucuggagaagcgcuuggaaaaccuaaauaagaaaauggaggacgguuuccuggacguguggacauacaacgccgagcuccugguucuuauggaaaaugagcgaacucuggauuuccacgacucaaacgugaagaauuuguaugauaaagucagaaugcagcucagggacaacgugaaggaacugggcaacggguguuuugaguucuaccauaaaugcgaugacgaguguauggauaguguaaagaauggaaccuacgacuauccaaaguacgaagaggaaagcaaauuaaaccggaaugagauuaagggcguuaaacuguccucuauggguguguaucagauccuagcgauauacgccacagucgcagggagccucucacuggcuauuaugauggccggcaucaguuuuuggaugugcuccaacggaagccuucaaugccguaucuguauuuga

SEQ ID NO: 128278 - RNA, 1701 nt, Artificial Sequence
  derived and/or modified sequence opt3 from hemagglutinin__InfluenzaA__ADT78908
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaaagcuccccuucagcuggguaaguguaauaucgccggcuggguguuggggaacccugagugcgaaagucuccugagcaauagguccuggucuuauauugcagagaccccaaacucggaaaauggaacauguuacccgggcgauuucgccgacuaugaggagcugcgggaacaacucucaagcgucaguuccuuugagcgcuucgaaaucuuucccaaggagcgaucuuggccuaaacauaacaccacucguggugugacagcugcaugcagccacgccagaaaguccucauucuacaaaaauuuaguuuggcugaccgaggcuaacgggaguuauccaaaucuuagcaagucuuacgugaacaaucaggaaaaagaggucuuggugcuguggggaguacaucaccccuccaacauugaagaucagaggacgcuauaucggaaggacaacgccuacguuucaguggucagcaguaauuacaaccgcagauuuacuccugagaucgcgaagaggccaaaagugcgggaucagcccggccgcaugaauuauuacuggacccuccuggaaccuggcgacacaauaaucuucgaggcaacugggaaccuuauugccccaugguaugcuuuugcccugucucgaggaccggguuccggcaucauuaccagcaaugcacccauggaugagugugacacaaagugccaaaccccucagggggcuaucaacucgucuuugccauuccagaauauacaccccgugacgauuggagaauguccuaaauacgucagauccacuaagcucaggaugguuacaggccugcggaacaucccaucaauucagagucgugguuuauuuggggccaucgcgggauucaucgagggcggcuggaccgggaugauggauggaugguaugguuaccaucaccaaaaugaacagggcagcggguaugccgcagaccagaaauccacucagaacgcuauuaauggaauaacaaacaagguaaauucugugaucgagaaaaugaacacccaauuuacggccgugggcaaggaguucaauaagcuggaaaaacgcauggagaaccucaacaagaaagucgacgaugguuuucuugacauuuggaccuacaaugcugaacuguuggugcuacuggagaacgaaagaacacucgauuuccaugacagcaauguuaagaaccuguacgagaaagugaagaaucagcuuaggaacaaugccaaggaacuggggaacggcugcuucgaguuuuaucacaaaugugauaaugagugcauggaaucagucaagaacggaacuuacgacuaucccaaauacagugaggaauccaaguugaaucgggagaaaaucgauggcgugaagcucgagagcauggggguauaucgaauacuggcaauuuacucuaccguugccucaaguuuagugcugcuagucagccucggagcuaucuccuucuggaugugcucuaacgguucgcugcagugucgcaucugcauuuga

SEQ ID NO: 128279 - RNA, 1701 nt, Artificial Sequence
  derived and/or modified sequence opt3 from hemagglutinin__InfluenzaA__ADT78929
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaucgcuccccuucagcuggguaaauguaauauugccggcuggaucuuggggaacccugagugcgaaagucuccugagcaagagguccuggucuuauauugcagagaccccaaauucggaaaacggaacauguuacccgggcgauuucgccgacuaugaggagcugcgggaacaacucucaagcgugaguuccuuugagcgcuucgaaaucuuucccaaggagcgaucuuggccuaaacauaauauaacccguggugucacugcugcaugcagccacgccgggaaguccucauucuacaaaaacuuacuguggcuuacagagaccaagggaaguuauccaaauuugagcaaaucuuacgugaacaauaaggaaaaggagguucuggugcuauggggcguccaucaccccuccaacaucgaagaucagaaaacgcucuauagaaaggagaaugcuuacgugucaguaguuagcaguaacuacaacaggcgguuuacuccugaaauugccgagcgcccaaaagugagaggccaggcggggaggaugaauuauuacuggacccugcuugagcccggagacacaaucauuuucgaagcaaacgguaaucugaucgccccuugguaugcuuuugccuugucucggggccucggguccggaauaauuacuagcaacgcaucgauggaugagugugacaccaagugccagacaccacaaggcgcuaucaauucuucccugccguuccagaacauucaccccgucaccaucggugaauguccuaaauacgugaagucaacgaaauuacgcauggugacugggcugcgaaauaucccaaguauucagagcagaggacucuuuggcgccauagcgggcuucaucgaagggggauggacagguaugauugauggcugguauggguaccaucaccagaacgaacaaggauccggcuaugccgcagaccagaagucuacccagaaugcuaucaacgguauaacuaauaaggucaacagcguuauugagaaaaugaauacacaguuuaccgccguggggaaggaguucaacaaacuugaaaagaggauggagaaucugaacaaaaagguagaugacggcuuuuuggacaucuggacguacaacgcugaacuacuggugcuccuggagaaugaacggacccuugauuuccaugacucaaacgucaagaaucuguacgagaaagugaagaaccaauugcguaauaacgccaaagagaucggaaauggcugcuucgaauuuuaucacaaguguaacaaugagugcauggaaaguguuaaaaacgggacauacgauuaucccaaguacuccgaggagagcaagcucaaucgcgagaaaauugacggagugaagcuggagucuaugggugucuaucagaucuuagcaauuuacucaacuguggccaguagccugguacuacucguuucccugggcgcuauaucuuucuggaugugcucgaacgggagccuucaguguagaaucugcauuuga

SEQ ID NO: 128280 - RNA, 1701 nt, Artificial Sequence
  derived and/or modified sequence opt3 from hemagglutinin__InfluenzaA__ADT78936
augaaggccaaacugcucgugcuucugugcgcuuugagcgcaaccuacgccgacacaaucuguauuggcuaucacgcgaacaauuccacugauacggucgacaccguuuuagagaagaacgugacaguaacucauucugugaaucugcuagaagauucacacaacgggaaacucugcagacugaagggaaaagcuccccuucagcuggguaaguguaauauagccggcuggaucuuggggaacccugagugcgaaagucuccugagcaagagguccuggucuuacauugcagagaccccaaauucggaaaacggaacauguuauccgggcgacuucgccgauuacgaggagcugcgggaacaacucucaagcgucaguuccuuugagcgcuucgaaaucuuucccaaagagucuagcuggccuaagcauaauaccacucgaggugugacagcugcaugcucccacgcccguaaaucaaguuucuauaagaacuuacuguggcuuaccgaggcuaaugggagcuacccaaacuugucuaaauccuauguuaauaaccaggaaaaggaggugcugguccuauggggagugcaucaccccucaaauauugaagaccagagaacgcucuacaggaaggagaacgccuacguaagcguugugaguucuaacuauaaucggcgcuuuacuccugaaaucgcggagagaccaaaagucaggaaccaggcaggccggaugaauuacuauuggacccugcuugagcccggcgauacaauaaucuucgaagccaacgggaaucugauugcuccuugguacgccuuugcauugucccgcggacucgguagcggcaucauuacuucgaacgcuucuauggacgagugugauaccaagugccaaacaccacagggggccaucaauuccucacugccguuccagaacauacaccccgugaccauuggagaauguccuaaauaugugaagaguacgaaauuacgaauggucacuggccugagaaauaucccaagcauucaguccaggggucucuuuggggcgaucgccggauucaucgagggcggcuggacagggaugauggacggaugguacgguuaucaucaccaaaacgaacagggcucuggguacgcagcugaucaaaagagcacccagaaugccauuaacggaauaacuaauaaaguuaacucagugaucgagaagaugaauacacaguuuaccgcuguaggcaaggaguucaacaaacuugaaaagcggauggagaaccugaauaaaaagguggacgauggguuuuuggacauuuggacguacaacgccgaacuacugguccuccuggagaaugaacguacccuugacuuccaugauaguaacgugaaaaaucuguaugagaagguuaagaaccaguugcgcaauaacgcaaaagagcucgguaauggcugcuucgaauuuuaccacaagugugacaacgagugcauggaauccgugaaaaauggaacauaugauuaccccaaguauagcgaggagucuaaacugaacagagaaaagaucgacggcgucaaguuagagucaauggggguguacaggauacuggccauuuauaguacuguagcuagcucccuaguucuccuggugucucuuggagcgaucucguucuggaugugcagcaaugguuccuugcagugucggaucugcauuuga

SEQ ID NO: 128281 - RNA, 1689 nt, Artificial Sequence
  derived and/or modified sequence opt3 from hemagglutinin__InfluenzaA__ADT78961
auggccaucauuugccugauacuccuuuucaccgcugugagaggcgaccagaucuguauuggguaccacgcaaacaauagcacagagaaggucgauacuauccuggaaaggaacguuacggugacccaugccaaagacauuuuggagaagacacacaauggaaaauuaugcaagcugaacgguaucccaccucuagaacucggcgauuguuccauagcgggguggcugcuuggaaauccagagugcgaccggcuguugucuguaccggaauggucauauaucauggagaaagagaacccccgcgauggccucuguuacccugguaguuuuaaugacuaugaggagcugaagcaucugcucagcuccgugaagcacuucgaaaaagucaagauuuuacccaaaaaccgauggacucaacauaccacaaccgggggaucucgugcuugcgccgugucgggcaaucccucauuuuucagaaacaugguuuggcugacuaagaaaggcagcaauuacccuguggcaaaggggaguuauaacaauacauccggagagcagaugcuuaucauuugggguguccaccacccaaacgaugagaccgaacagaggacguuguaccagaauguggagacuuauguaucuguuagcaccuccacacugaacaagcggucaacucccaaaaucgccacccgcccugaagugaacggccuagggaguagaauggaguuuagcuggacacuccuggacaugugggauaccauaaauuucgaaucuacgggaaaccuuauugcuccagaguacggcuuuaagaucuccaaaagggguucaagcgggauuaugaagacugagggaacacuggaaaauugugagaccaaaugccaaacuccguugggcgcaaucaacacaacccuccccuuccauaauguccacccucugacgaucggcgaauguccaaaguacgugaaaagugagaaguuagugcuggccaccgggccccggaacgucccucagauugaaucucgcggacucuuuggugcuauagccggcuucaucgaagggggauggcagggcaugguugacgguugguauggguaccaucacuccaaugaucagggcagcggauaugcggcagacaaggagucgacacaaaaagccuuugauggcauuacuaacaagguaaauucugugaucgagaaaaugaacacccaguucgaagcuguggggaaggaauuuuccaaucuugagcgaagacuggaaaacuugaauaaaaagauggaggacggauuccuagacgucuggacauacaacgccgagcugcucgugcugauggaaaaugagaggacucuugauuuccacgacucaaacguuaagaaccuguaugauaaagugcggaugcaguugcgugacaaugucaaggaacucgguaacggcugcuuugaguucuaccauaaaugugaugacgagugcaugaauagugugaagaacgggaccuaugauuacccaaaauacgaagaggaaagcaagcugaaucgcaacgagauaaagggaguaaaauuauccucuaugggcguuuaucagauucuggugaucuacgcaacagucgcugguagccuaucacucgccaucaugauggcggggauuaguuuuuggaugugcuccaauggcagccugcaauguagaaucugcauuuga

SEQ ID NO: 128282 - RNA, 1701 nt, Artificial Sequence; identical to SEQ ID NO: 122780
  derived and/or modified sequence opt3 from hemagglutinin__InfluenzaA__ADT78971

SEQ ID NO: 128283 - RNA, 1701 nt, Artificial Sequence; identical to SEQ ID NO: 122321
  derived and/or modified sequence opt3 from hemagglutinin__InfluenzaA__ADT79010

SEQ ID NO: 128284 - RNA, 1701 nt, Artificial Sequence; identical to SEQ ID NO: 122780
  derived and/or modified sequence opt3 from hemagglutinin__InfluenzaA__ADT79030

SEQ ID NO: 128285 - RNA, 1701 nt, Artificial Sequence; identical to SEQ ID NO: 123358
  derived and/or modified sequence opt3 from hemagglutinin__InfluenzaA__ADT79050

SEQ ID NO: 128286 - RNA, 1701 nt, Artificial Sequence
  derived and/or modified sequence opt3 from hemagglutinin__InfluenzaA__ADT79108
augaaggccagacugcucauccuucugugcgcuuugagcgcaaccgacgccgauacaauuuguauaggcuaccacgcgaacaauuccacugacacgguggauaccgucuuagagaaaaacguuacagugacucauucuguaaaucugcuagaagacucacacaacgggaagcucugcaggcugaaaggaaucgcuccccuucagcuggguaaguguaauauugccggcuggaucuuggggaacccugagugcgaaagucuccugagcaaucgguccuggucuuauauugcagagaccccaaacucggaaaauggaacauguuacccgggcgauuucgccgacuaugaggagcugcgcgaacaacucucaagcgugaguuccuuugagcgauucgaaaucuuucccaaagagcguucuuggccuaagcauaacauaaccagaggugucacugcugcaugcagccacgccaagaaauccucauucuacaagaauuuacuguggcuuacagaggcuaacgggaguuauccaaauuugaucaaaagcuacgugaacaauaaggaaaaagagguucuggugcuauggggaguccaucaccccucuaacauugaagaucagaggacccucuaucggaaggagaacgccuacguguccguaguuucaagcaauuacaaccgcagauuuacgccugaaaucgcggagaggccaaaggugcggggccaggcaggccgcaugaauuauuacuggacucugcuugagcccggggacaaaauuaucuucgaagccaacggaaaucugauagcuccuugguaugccuuugcauugagucgaggucucggcucugggauuaucaccuccaacgcuagcauggaugagugugacacaaagugccagacuccacaaggagccauuaauucgucucugccguuccagaacauccaccccgucaccaucggcgaauguccuaaauacgugagauccacaaaguuaaggauggugaccggucugcggaauauuccaucaauacagagucgugggcucuuuggagcgaucgccggcuucauugagggcggguggacgggaauggucgaugguugguauggcuaccaucaccagaacgaacaagggagcggauaugcagcugaccagaaauccacucagaaugccaucaacggcauaacaaauaagguuaacucugugauugagaaaaugaauacccaguuuacugcuguagguaaggaguucaacaaacuugaaaaacgcauggagaaccugaauaagaaaguggaugacggguuuuuggacaucuggacauacaacgccgaacuacugguccuccuggagaaugaaagaacccuugauuuccaugacagcaacgugaagaaucuguacgagaaaguuaagaaccaauugaggaauaacgcaaaggagaucggcaauggaugcuucgaauuuuaucacaaaugugauaacgagugcauggaaucagugaagaauggcacguacgacuaucccaaauacagugaggaguccaagcucaaccgggaaaagauugauggggucaagcuggagagcaugggaguguaucagaucuuagccauuuacucuaccguagcuucaagucugguucuacucgugagccugggugcgauauccuucuggaugugcucuaauggcucgcuucagugucgaaucugcauuuga

SEQ ID NO: 128287 - RNA, 1689 nt, Artificial Sequence
  derived and/or modified sequence opt3 from hemagglutinin__InfluenzaA__ADT79119
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgauaucgccacccgcccuaaagugaacggacuaggcgguagaauggaguuuucauggacacuccuggacaugugggauaccauaaacuucgaaaguacggggaaucuuauugcuccagaguacggauuuaagaucagcaaaagggggucuuccggcauuaugaagacugaaggcacacugggaaacugcgagaccaaaugucaaacuccguugggugcaaucaauacaacccuccccuuccauaacguccacccucugacgaucggcgagugcccaaaguaugugaaaucagaaaaguuagugcuggccaccgggcuccggaaugucccccagauugagagccgcggacuuuuuggcgcuauagccgguuucaucgaagggggcuggcagggaaugguugacggcugguacggguaucaucacaguaacgaucagggaucugguuacgcggcagacaaggaguccacacaaaaagccuuugacggcauuacuaauaaggugaacagcguaaucgagaaaaugaauacccaguucgaggcuguggggaaggaguuuucgaaccuggaacgaagauuggagaaucuaaacaaaaagauggaagauggauuccuggacgucuggacauauaaugccgagcuccuggugcuuauggaaaacgagaggacucuggauuuccacgacucuaauguuaagaacuuguacgauaaagugcggaugcagcuccgugacaacgucaaggagcugggcaaugguuguuuugaguucuaucauaaaugcgaugacgaauguaugaacuccgugaagaaugggaccuacgauuacccuaaauaugaagaggagucaaaguuaaaccgcaaugaaauaaagggcguaaaacugaguagcaugggaguuuaccagauucuagcaaucuaugcuacaguggccggcucccucucucuggcgaucaugauggccgggauuagcuuuuggaugugcucaaacggaagucuucaaugcagaaucuguauuuga

SEQ ID NO: 128288 - RNA, 1689 nt, Artificial Sequence
  derived and/or modified sequence opt3 from hemagglutinin__InfluenzaA__ADT79129
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgagauggccucugcuauccugguucauuuaaugacuacgaggaacugaagcaucugcucaguagcgugaagcacuucgaaaaagucaagauuuuaccaaaagaucguuggacucaacauaccacaaccgggggauccagagcuugugccgugucuggcaaccccucguuuuucaggaauaugaucuggcugacuaagaaaggcucaaacuauccuguugcaaaggggagcuacaauaacacaaguggagagcagaugcuuauuaucuggggugugcaccacccaaaugacgagaccgaacagcggacguuguaucagaacgucggcacuuacguguccguaguuaccucuacacugaauaagcgcagcacucccaaaauagccaccagaccuaaggugaacgggcuaggaggcaggauggaguuuuccuggacacuccuggauaugugggacaccauuaacuucgaaucaacggguaaucuuaucgcuccagaguacggguuuaaaauuaguaagcggggaagcucuggcaucaugaaaacugaaggcacacuggagaacugcgagaccaagugucaaacuccguugggggcaaucaauacaacccuccccuuccauaacguccacccucuggccauuggagaaugcccaaaauaugugaaguccgagaaguuagugcuggcuacgggucuccgcaaugucccccagauagaaucacgaggccuuuuuggggccaucgcgggauucauugagggcgguuggcaggggaugguugauggcugguacggauaucaucacagcaacgaccagggcaguggguacgcagccgauaaagaaucuacccaaagagcuuuugacggaaucacaaauaaggugaacuccguaauagagaaaaugaauacucaguucgaggccguggguaaggaauuuagcaaccuggagaggcgguuggaaaaucuaaacaaaaagauggaggacggcuuccuggaugucuggaccuauaaugcagaacuccuggugcuuauggagaacgagcguacacuggacuuccacgauucgaauguuaagaacuuguacgacaaagugcgcaugcagcucagagauaacgucaaggaacuggggaauggauguuuugaguucuaucauaaaugcgacgaugaauguaugaacucugugaagaauggcacuuacgacuacccuaaauaugaggaggaauccaaguuaaacaggaaugagauuaaggguguaaaacugucaaguauggggguuuaccagauccuagcuaucuaugccaccguggcgggcagccucucccuggccauuaugauggcaggaaucucuuuuuggaugugcagcaacggcucacuucaaugccggauuuguauauga

SEQ ID NO: 128289 - RNA, 1701 nt, Artificial Sequence
  derived and/or modified sequence opt3 from hemagglutinin__InfluenzaA__ADT79232
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauaagcacccuauuacuaucgguaagugcccaaaauauguaaagucaacaaaacugcgccuugccaccgggcugagaaacgugcccaguauccagagcaggggauuguuuggcgcgauugccggcuucauagaagggggauggacugguauggucgacggcugguacggguaucaucaccagaaugaacaaggauccggcuacgcagcugaugugaagucuacacagaacgccaucgacgagauuaccaauaaaguuaacagcgugaucgagaagaugaauacgcaguuuaccgcugucgguaaggaguucaaccaccucgaaaaacggauagaaaaucugaacaagaaaguggaugacggguucuuagauauuuggacauacaaugccgagcugcucguacuucuggaaaacgagcgcacuuuggacuaucaugauucaaauguuaagaaccuauacgagaaagugcgaagucagcugaagaacaaugcaaaggaaaucggcaacggauguuuugaguucuaucacaaaugcgacaauaccuguauggaauccgucaagaacggcacauacgauuauccuaaauacagcgaggaagccaagcucaauagagaggagaucgacggggugaaacuggaaucuacuaggauuuaucaaauccuugcuauuuacucaaccgucgcgaguagccugguguugguugugucccucggagcaauaucuuuuuggaugugcucgaacgguagccugcagugccggaucuguauuuga

SEQ ID NO: 128290 - RNA, 1701 nt, Artificial Sequence
  derived and/or modified sequence opt3 from hemagglutinin__InfluenzaA__ADT79242
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacgugccuucaauucagaguaggggauuguuuggcgcgauagccggcuucaucgaagggggauggacugguauggucgacggcugguacggguaucaucaccagaaugaacaaggaagcggcuacgcagcugaucucaaauccacacagaacgccauugacgagaucaccaauaaggugaacucuguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaaucggcaacggauguuuugaguucuaucacaagugcgacaauaccuguauggaaagugugaaaaacggcacauacgauuauccaaaguacuccgaggaagccaaacugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 128291 - RNA, 1701 nt, Artificial Sequence
  derived and/or modified sequence opt3 from hemagglutinin__InfluenzaA__ADT91182
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaccauugucuacagcaucaaguuggagcuacauuguugagaccuccucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccacggccuguccacaugcuggggcaaaaucauuuuauaagaaucugaucuggcucgugaaaaagggaaacaguuaccccaaauuaagcaagucuuauauaaaugacaagggcaaagaaguacugguucuuuggggcauccaccacccuccaacuuccgccgaucaacagucauuguaccagaacgcugacgccuacguguucgucgggaccagccgcuauaguaagaaauuuaagcccgagauugcgauccgaccuaaagugcgugaucaggagggaagaaugaauuacuauuggacacugguggaaccaggugacaagauuacuuucgaggcaaccggcaaccuagucguuccgagguacgccuuugcuauggaacggaacgccgggucuggaaucauaauuuccgauacacccgugcaugacugcaauaccacgugucaaacuccuaaaggcgcaaucaacacaagccucccauuccagaauauucaccccaucaccaucgguaagugcccuaaguauguaaaaucgacuaagcugcgccuugcuacagggcugagaaacgugccaucuauucaguccaggggauuguuuggcgccauagcgggcuucaucgaagggggauggaccgguauggucgacggcugguacggguaucaucaccagaaugaacaaggaucaggcuacgccgcagaucucaaaaguacgcagaacgcuauugacgguaucaccaauaaggugaacagcguuauagagaaaaugaauacacaguuuacugccguggggaaggaguucaaccaccuggaaaagcggauugagaauuuaaacaaaaaggucgaugacggcuuccuggauaucuggaccuacaaugcugaacuccuugugcuguuggagaacgaacgcacacuagacuaucaugauuccaauguaaagaaccuguacgagaagguucgaucucagcucaaaaacaaugccaaggagaucggaaacggcuguuuugaguucuaucacaagugcgacaauacuuguauggaaagcgugaaaaacgggaccuacgauuaucccaaguacucagaagaggcaaaacugaauagagaagagauugacggagucaaacuugagaguacaaggaucuaucaaauucuggccauauacuccaccguggcuagcucuuugguccucgugguuucacugggugcgaucaguuuuuggaugugcagcaacggcuccuuacagugccggauuuguaucuga

SEQ ID NO: 128292 - RNA, 1701 nt, Artificial Sequence
  derived and/or modified sequence opt3 from hemagglutinin__InfluenzaA__ADU20561
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccaggugauuuuaucgacuacgaagaacucagagagcagcugagcaguguguccucuuucgaaagguuugagauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagaaguacugguucuuugggggauccaccaccccucaacgagcgcugaucaacagaguuuguaccagaacgccgacgcguacguguucgucggaacuucucgguauuccaagaaauuuaagccugagauugcaauccgcccaaaagugcgagaucaggagggucguaugaauuacuauuggacccugguggaacccggcgacaagauuacauucgaggccacugggaaccuagucguuccuagauacgcuuuugccauggaaaggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaucucaaauccacccagaacgccauugacaagaucacgaauaaagugaacucuguuauagagaagaugaauacccaguuuacagcuguggggaaggaguucaaccaccuggagaaaaggauugagaauuuaaacaagaaagucgaugacggcuuccuggauaucuggacuuacaaugccgaacuccuugugcuguuggagaacgaacggacccuagacuaucaugauagcaauguaaagaaccuguacgagaaaguucgcucacagcucaagaacaaugcaaaggagaucggaaacggcuguuuugaguucuaucacaaaugcgacaauacauguauggaaagugugaagaacgggacuuacgauuauccuaaauacuccgaagaggccaagcugaaucgagaagagauugacggagucaaacuugagagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 128293 - RNA, 1701 nt, Artificial Sequence
  derived and/or modified sequence opt3 from hemagglutinin__InfluenzaA__ADU20562
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaagauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaagacaagcuccuggcccaaccacgauucaaauaaaggugucaccgccgcuuguccucaugcaggggccaagaguuuuuauaaaaaccugaucuggcucgugaagaaaggaaauagcuacccaaaguuaucuaaguccuauauaaacgacaaaggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaucuagucguuccuagguacgcuuuugccauggaacggaacgcagggagcggaaucauaauuucggauaccccagugcaugacugcaacacaaccugucaaacgccgaagggcgcuaucaauacuucucuccccuuccagaacauucacccuaucacaaucgguaagugcccaaaauauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguaaauucuguuauagagaagaugaacacccaguuuacagcuguggguaaagaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaucuguacgagaagguucgaucacagcucaagaacaacgcaaaagagaucggcaauggauguuuugaguucuaucacaagugcgacaacacauguauggaaagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128294 - RNA, 1701 nt, Artificial Sequence
  derived and/or modified sequence opt3 from hemagglutinin__InfluenzaA__ADU25478
auggaggccaagcuguucgugcucuuuugcgcuuucaccgcacuuaaagccgacacaaucugugucggcuaccacgcgaacaauagcacugauacgguugacaccauucuggaaagaaacgugacaguaacucauuccgugaauuuguuagagucuucacacaacgggaagcugugcagucuaaauggaaaagcuccccuccagcuggguaacuguaaugucgccggcuggauacuugggaacccugaaugcgaucuguugcucaccgugaauagcugguccuauaucauugagacaucuaccucgaagaacggagcauguuacccaggcgaauuugccgacuaugaggagcugagggaacaacugucaacuguuagcaguuucgagcgguuugaaaucuucccgaaagcuacauccuggcccaaucaugagaccacgaaggguacuaccguggcaugcucucacagcggggccaacuccuuuuaccgcaaucucuuauggauugucaagaaaggaaacucauauccuaagcugaguaaaagcuacacaaauaacaagggcaaagaggugcuuguaaucuggggcguucaucacccacccacugauucugaccagcagaccuuguaucagaacaaucacacauacguguccgucgggucaagcaaguacuaucaacgauucaccccugaaauagugacgcguccaaaggugagagagcaggcuggaaggaugaacuacuauuggacucugcuagaucagggugacacaaucaccuuugaagccacuggcaaucucauugcgcccuggcaugcauucgcccugaacaaagggaguucuuccggaaucaugaugagcgaugcucacguccauaauuguacaaccaagugccagacgccucacggcgcccuuaaaucgaaccugccauuucaaaauguucacccgauuaccaucggugagugucccaaguacgugaaaucuacacaguugcggauggcaacugggcuccgcaacauaccuuccauucagucaagaggacuguucggcgcuaucgccggcuuuauugaagggggauggaccgguaugaucgacggcugguauggguaccaucaccagaaugagcaaggaaguggcuaugcggccgaucaaaagagcacacagaucgcaauugacgguauauccaacaaaguaaauucugugaucgagaagaugaacguccaguucacuagcguggggaaggaauuuaauaacuuagagaaaaggauugaaaaucugaacaagaaaguugaugacggcuuccucgacaucuggaccuacaacgcugagcuucugauauugcuagaaaaugagcggacacuggauuuccaugacuuuaacgugaagaaucucuacgagcgcgucaaaucacagcugcgaaacaaugccaaggaaauuggaaacggcugcuucgaguuuuaucacaaguguaauaacgaaugcauggagagugugaaaaaugggaccuacaacuauccaagauacuccgaagagagcaaacuuaauagggaggaaaucgauggaguaaagcuggagucuguuggugugcaucagaucuuggcuauuuauucaacugucgccaguagccucgugcuguuagucucccugggcgcaaucucuuucuggaugugcucgaacgggagccuacagugucggauuugcauauga

SEQ ID NO: 128295 - RNA, 1701 nt, Artificial Sequence
  derived and/or modified sequence opt3 from hemagglutinin__InfluenzaA__ADU59558
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugauaagaucacgaauaaagugaacucuguuauagagaagaugaauacccaguuuacagcuguggggaaggaguucaaccaccuggaaaaacggauugagaauuuaaacaagaaagucgacgauggcuuccuggacaucuggacuuacaaugccgaacuccuugugcuguuggagaacgaacgcacccuagauuaucaugacagcaauguaaagaaccuguacgagaaaguucgaucacagcucaagaacaaugcaaaggagaucggaaacggcuguuuugaguucuaucacaaaugcgauaauacauguauggagagugugaagaacgggacuuacgacuauccuaaauacuccgaagaggccaagcugaauagagaagagauugauggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 128296 - RNA, 1701 nt, Artificial Sequence; identical to SEQ ID NO: 124685
  derived and/or modified sequence opt3 from hemagglutinin__InfluenzaA__ADU59579

SEQ ID NO: 128297 - RNA, 1701 nt, Artificial Sequence; identical to SEQ ID NO: 124685
  derived and/or modified sequence opt3 from hemagglutinin__InfluenzaA__ADU59590

SEQ ID NO: 128298 - RNA, 1701 nt, Artificial Sequence; identical to SEQ ID NO: 124685
  derived and/or modified sequence opt3 from hemagglutinin__InfluenzaA__ADU59601

SEQ ID NO: 128299 - RNA, 1701 nt, Artificial Sequence; identical to SEQ ID NO: 124685
  derived and/or modified sequence opt3 from hemagglutinin__InfluenzaA__ADU59612

SEQ ID NO: 128300 - RNA, 1701 nt, Artificial Sequence; identical to SEQ ID NO: 124685
  derived and/or modified sequence opt3 from hemagglutinin__InfluenzaA__ADU59768

SEQ ID NO: 128301 - RNA, 1701 nt, Artificial Sequence; identical to SEQ ID NO: 124685
  derived and/or modified sequence opt3 from hemagglutinin__InfluenzaA__ADU59769

SEQ ID NO: 128302 - RNA, 1701 nt, Artificial Sequence; identical to SEQ ID NO: 124685
  derived and/or modified sequence opt3 from hemagglutinin__InfluenzaA__ADU59771

SEQ ID NO: 128303 - RNA, 1701 nt, Artificial Sequence; identical to SEQ ID NO: 124685
  derived and/or modified sequence opt3 from hemagglutinin__InfluenzaA__ADU59772

SEQ ID NO: 128304 - RNA, 1701 nt, Artificial Sequence; identical to SEQ ID NO: 124685
  derived and/or modified sequence opt3 from hemagglutinin__InfluenzaA__ADU59774

SEQ ID NO: 128305 - RNA, 1701 nt, Artificial Sequence; identical to SEQ ID NO: 124685
  derived and/or modified sequence opt3 from hemagglutinin__InfluenzaA__ADU59906

SEQ ID NO: 128306 - RNA, 1701 nt, Artificial Sequence; identical to SEQ ID NO: 124685
  derived and/or modified sequence opt3 from hemagglutinin__InfluenzaA__ADU59916

SEQ ID NO: 128307 - RNA, 1701 nt, Artificial Sequence; identical to SEQ ID NO: 124685
  derived and/or modified sequence opt3 from hemagglutinin__InfluenzaA__ADU76756

SEQ ID NO: 128308 - RNA, 1701 nt, Artificial Sequence; identical to SEQ ID NO: 124685
  derived and/or modified sequence opt3 from hemagglutinin__InfluenzaA__ADU76757

SEQ ID NO: 128309 - RNA, 1701 nt, Artificial Sequence; identical to SEQ ID NO: 124685
  derived and/or modified sequence opt3 from hemagglutinin__InfluenzaA__ADU76758

SEQ ID NO: 128310 - RNA, 1701 nt, Artificial Sequence; identical to SEQ ID NO: 124685
  derived and/or modified sequence opt3 from hemagglutinin__InfluenzaA__ADU76759

SEQ ID NO: 128311 - RNA, 1701 nt, Artificial Sequence; identical to SEQ ID NO: 125045
  derived and/or modified sequence opt3 from hemagglutinin__InfluenzaA__ADU76761

SEQ ID NO: 128312 - RNA, 1701 nt, Artificial Sequence; identical to SEQ ID NO: 124685
  derived and/or modified sequence opt3 from hemagglutinin__InfluenzaA__ADU76762

SEQ ID NO: 128313 - RNA, 1701 nt, Artificial Sequence
  derived and/or modified sequence opt3 from hemagglutinin__InfluenzaA__ADU76764
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugaggccucuucgucaaacaauggaaccugcuauccaggcgacuuuaucgauuacgaggagcucagggagcagcugagcaguguguccucuuucgaacgguuugagauuuucccgaagacuagcuccuggcccaaccacgacucaaauaagggugucacagcugcauguccucaugccggggcuaaaaguuuuuauaagaaccugaucuggcucgugaaaaagggaaauagcuacccaaaauuaucuaaguccuauauaaacgauaagggcaaagaaguacugguucuuuggggcauccaccaccccucaaccagcgccgaccaacagaguuuguaccagaaugcggaugcauacguguucgucgggacgucucgcuauuccaagaaauuuaagccugagauugccauccgaccaaaagugcgugaccaggagggaagaaugaacuacuauuggacucugguggaacccggugauaagauuaccuucgaggcuacaggcaaccuagucguuccuagguacgccuuugcaauggaacggaaugcugggagcggaaucauaauuucggacacuccagugcaugauugcaacaccacaugucaaaccccgaaaggcgccaucaauacgucucuccccuuccagaacauucacccuaucacuaucgguaagugcccaaaguauguaaaauccacaaagcugcgccuugcgaccgggcugagaaaugugcccucaauucagaguaggggauuguuuggcgccauagcaggcuucaucgaagggggauggacugguauggucgacggcugguacggguaucaucaccagaacgaacaaggaagcggcuacgcugccgaccucaaauccacacagaaugcuauugaugagaucaccaacaagguaaauucuguuauagagaaaaugaacacgcaguuuauugccguggguaaggaguucaaucaccuggaaaagcggaucgaaaacuuaaauaaaaaggucgacgauggguuccuggacaucuggaccuacaacgcagagcuccuugugcuguuggaaaaugagcgcacacuagauuaucaugacagcaacgugaaaaaccuguacgagaagguucgaucacagcucaaaaauaacgccaaggaaauuggcaauggauguuuugaguucuaucacaagugcgauaacacuuguauggaaagugugaaaaauggcaccuacgacuauccuaaguacuccgaggaagcuaaacugaacagagaggagaucgauggggucaaacuugaaagcacaaggauuuaucaaauacuggcgaucuacucuacuguggcaucaaguuugguccucgugguuagccugggagccauuuccuuuuggaugugcucuaaugguucguuacagugccggaucuguaucuga

SEQ ID NO: 128314 - RNA, 1701 nt, Artificial Sequence
  derived and/or modified sequence opt3 from hemagglutinin__InfluenzaA__ADU76765
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuucagucgcgaguagcuuggugcucgucgugucccugggagcaauuucuuuuuggaugugcucgaacgguagcuuacagugccggaucuguaucuga

SEQ ID NO: 128315 - RNA, 1701 nt, Artificial Sequence; identical to SEQ ID NO: 126282
  derived and/or modified sequence opt3 from hemagglutinin__InfluenzaA__ADU76766

SEQ ID NO: 128316 - RNA, 1701 nt, Artificial Sequence
  derived and/or modified sequence opt3 from hemagglutinin__InfluenzaA__ADU76767
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugauaagaucacgaauaaagugaacucuguuauagagaagaugaauacccaguuuacagcuguggguaaggaguucaaccaccuggagaaacggauugaaaauuuaaacaagaaagucgacgauggguuccuggacaucuggacuuacaaugccgagcuccuugugcuguuggaaaacgagcgcacccuagauuaucaugacagcaauguaaagaaccuguacgagaaaguucgaucacagcucaagaacaaugcaaaggaaaucggcaacggauguuuugaguucuaucacaaaugcgauaauacauguauggaaagugugaagaacggcacuuacgacuauccuaaauacuccgaggaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 128317 - RNA, 1701 nt, Artificial Sequence
  derived and/or modified sequence opt3 from hemagglutinin__InfluenzaA__ADU76768
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucuaaguauuccaaaaaguuuaaaccugagaucgcaauucgcccaaaggugcgagaucaggagggacguaugaauuacuauuggacucugguggaacccggugacaaaaucaccuucgaggccacaggcaaccuagucguuccuagauacgcuuuugccauggaaaggaacgcagggagcggaauaauuaucucggauacuccagugcaugacugcaauaccacaugucaaaccccgaagggcgcuauuaacacgucucuccccuuccagaauauccacccuaucacuauugguaagugcccaaaauauguaaaguccacaaaacugcggcuugccaccgggcugcgcaacgugcccucaauacagaguagaggauuguuuggcgcgaucgccggcuucauugaagggggauggacugguauggucgacggcugguacggguaucaucaccagaaugaacaaggaagcggcuacgcagcugaucucaaguccacacagcacgccaucgacgagauaaccaacaaaguuaauucugugauugagaagaugaacacgcaguuuaccgcuguggguaaggaauuuaaucaucuggagaaaaggaucgaaaacuuaaauaagaaagucgaugacggguuccuggauaucuggacauacaacgccgagcuccuugugcuguuggaaaaugagcggacucuagacuaucacgauagcaacguaaagaaucuguacgagaaaguucgcucacagcucaagaacaacgcaaaggaaauuggcaauggauguuucgaguucuaucauaaaugcgacaacaccuguauggaaagugugaagaauggcacauacgauuauccuaaauacuccgaggaagccaagcugaaccgagaggagaucaauggggucaaacuugaaagcacuagaauuuaucaaauacuggcuaucuacucuaccguggcgucaaguuugguccucgugguuagccugggagcaauuuccuuuuggaugugcucuaacgguucguuacagugcaggaucuguaucuga

SEQ ID NO: 128318 - RNA, 1701 nt, Artificial Sequence; identical to SEQ ID NO: 124685
  derived and/or modified sequence opt3 from hemagglutinin__InfluenzaA__ADU76769

SEQ ID NO: 128319 - RNA, 1701 nt, Artificial Sequence; identical to SEQ ID NO: 124685
  derived and/or modified sequence opt3 from hemagglutinin__InfluenzaA__ADU76770

SEQ ID NO: 128320 - RNA, 1701 nt, Artificial Sequence; identical to SEQ ID NO: 124685
  derived and/or modified sequence opt3 from hemagglutinin__InfluenzaA__ADU76771

SEQ ID NO: 128321 - RNA, 1701 nt, Artificial Sequence; identical to SEQ ID NO: 125430
  derived and/or modified sequence opt3 from hemagglutinin__InfluenzaA__ADU76772

SEQ ID NO: 128322 - RNA, 1701 nt, Artificial Sequence; identical to SEQ ID NO: 124685
  derived and/or modified sequence opt3 from hemagglutinin__InfluenzaA__ADU76774

SEQ ID NO: 128323 - RNA, 1701 nt, Artificial Sequence; identical to SEQ ID NO: 124685
  derived and/or modified sequence opt3 from hemagglutinin__InfluenzaA__ADU76775

SEQ ID NO: 128324 - RNA, 1701 nt, Artificial Sequence; identical to SEQ ID NO: 124685
  derived and/or modified sequence opt3 from hemagglutinin__InfluenzaA__ADU76776

SEQ ID NO: 128325 - RNA, 1701 nt, Artificial Sequence; identical to SEQ ID NO: 124685
  derived and/or modified sequence opt3 from hemagglutinin__InfluenzaA__ADU76777

SEQ ID NO: 128326 - RNA, 1701 nt, Artificial Sequence; identical to SEQ ID NO: 124685
  derived and/or modified sequence opt3 from hemagglutinin__InfluenzaA__ADU76778

SEQ ID NO: 128327 - RNA, 1701 nt, Artificial Sequence; identical to SEQ ID NO: 127543
  derived and/or modified sequence opt3 from hemagglutinin__InfluenzaA__ADU76779

SEQ ID NO: 128328 - RNA, 1701 nt, Artificial Sequence; identical to SEQ ID NO: 124685
  derived and/or modified sequence opt3 from hemagglutinin__InfluenzaA__ADU76780

SEQ ID NO: 128329 - RNA, 1701 nt, Artificial Sequence; identical to SEQ ID NO: 126282
  derived and/or modified sequence opt3 from hemagglutinin__InfluenzaA__ADU76781

SEQ ID NO: 128330 - RNA, 1701 nt, Artificial Sequence; identical to SEQ ID NO: 125045
  derived and/or modified sequence opt3 from hemagglutinin__InfluenzaA__ADU76782

SEQ ID NO: 128331 - RNA, 1701 nt, Artificial Sequence
  derived and/or modified sequence opt3 from hemagglutinin__InfluenzaA__ADU76784
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaaacaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128332 - RNA, 1701 nt, Artificial Sequence; identical to SEQ ID NO: 124685
  derived and/or modified sequence opt3 from hemagglutinin__InfluenzaA__ADU76785

SEQ ID NO: 128333 - RNA, 1701 nt, Artificial Sequence; identical to SEQ ID NO: 124685
  derived and/or modified sequence opt3 from hemagglutinin__InfluenzaA__ADU76786

SEQ ID NO: 128334 - RNA, 1701 nt, Artificial Sequence
  derived and/or modified sequence opt3 from hemagglutinin__InfluenzaA__ADU76787
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccacaauauucauuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaccaccagaaugagcagggauccggcuacgcagcugaccucaaaucuacccaaaacgccauugaugagaucacgaauaaggugaacagcguuauagaaaagaugaauacccaguuuacagcuguggguaaggaguucaaccaucuggaaaagcggauugagaauuuaaacaaaaaggucgacgauggguuccuggacaucuggacuuacaaugccgaacuccuugugcuguuggagaacgagcgcacccuagauuaucacgacucaaauguuaaaaaccuguacgaaaagguacgaagucagcucaaaaacaaugcaaaggagaucggcaacggauguuuugaguucuaucauaagugcgauaauacauguauggaguccgugaaaaacggcacuuacgacuaucccaaguacagcgaagaggccaaacugaauagagaggaaauugauggggucaaacuugagucuaccaggaucuaucagauucuggcuauauacucaacaguggcgaguagcuugguccucgugguuucccugggagcaaucucuuuuuggaugugcucgaacgguagcuuacaaugccggauuuguaucuga

SEQ ID NO: 128335 - RNA, 1701 nt, Artificial Sequence; identical to SEQ ID NO: 128316
  derived and/or modified sequence opt3 from hemagglutinin__InfluenzaA__ADU76788

SEQ ID NO: 128336 - RNA, 1701 nt, Artificial Sequence; identical to SEQ ID NO: 128316
  derived and/or modified sequence opt3 from hemagglutinin__InfluenzaA__ADU76789

SEQ ID NO: 128337 - RNA, 1701 nt, Artificial Sequence; identical to SEQ ID NO: 124685
  derived and/or modified sequence opt3 from hemagglutinin__InfluenzaA__ADU76790

SEQ ID NO: 128338 - RNA, 1701 nt, Artificial Sequence; identical to SEQ ID NO: 124685
  derived and/or modified sequence opt3 from hemagglutinin__InfluenzaA__ADU76791

SEQ ID NO: 128339 - RNA, 1701 nt, Artificial Sequence; identical to SEQ ID NO: 128316
  derived and/or modified sequence opt3 from hemagglutinin__InfluenzaA__ADU76792

SEQ ID NO: 128340 - RNA, 1701 nt, Artificial Sequence
  derived and/or modified sequence opt3 from hemagglutinin__InfluenzaA__ADU76793
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcagggacgaagaguuuuuauaaaaaucugaucuggcucgugaagaaaggaaacagcuacccaaaguuaucuaaguccuauauaaaugacaaaggcaaggaaguacugguucuuuggggcauccaccaccccucaacuagcgccgaucaacagaguuuguaccagaacgcugacgccuacguguucgucgggaccucucgguauuccaaaaaguuuaaaccugagauugcgauccgcccaaaggugcgagaucaggagggacguaugaauuacuauuggacacugguggaacccggugacaaaauuacuuucgaggcaaccggcaaccuagucguuccuagauacgccuuugcuauggaaaggaacgccgggagcggaaucauaauuucggauacaccagugcaugacugcaauaccacgugucaaacuccgaagggcgcaaucaacacaucucuccccuuccagaauauucacccuaucaccaucgguaagugcccaaaauauguaaaguccacuaaacugcggcuugcuacagggcugcgcaacgugcccucaauucagaguagaggauuguuuggcgccauagcgggcuucaucgaagggggauggaccgguauggucgacggcugguacggguaucaucaccagaaugaacaaggaagcggcuacgccgcagaucucaaguccacgcagaacgcuauugacaaaaucaccaauaaggugaacucuguuauagagaagaugaauacacaguuuacugccguggguaaagaguucaaccaccuggaaaagaggauugagaauuuaaacaaaaaggucgaugacggguuccuggauaucuggaccuacaaugcugaacuccuugugcuguuggagaacgaacggacacuagacuaucaugauagcaauguaaagaaccuguacgagaagguucgcucacagcucaagaacaaugccaaagagaucggcaacggauguuuugaguucuaucacaagugcgacaauacuuguauggaaagugugaaaaacggcaccuacgauuauccuaaguacuccgaagaggcaaaacugaaucgagaagagauugacggggucaaacuugagagcacaagaaucuaucaaauucuggccauauacucuaccguggcuucaaguuugguccucgugguuagccugggagcgaucuccuuuuggaugugcucuaacgguucguuacagugcaggauuuguaucuga

SEQ ID NO: 128341 - RNA, 1701 nt, Artificial Sequence
  derived and/or modified sequence opt3 from hemagglutinin__InfluenzaA__ADU85911
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacaaugggaaacuguguaagcuaggagguaucgcuccccuccaucugggcaaaugcgacauugccggguggcuucugggaaacccugagugugaaucuuuguuuacagcaucaaguuggagcuacaucguggagaccccaaauuccgauaacggcacuugcuauccgggugacuucauuaauuacgaagaacucagagagcaccugucuucgguuagcucauuugaaagguucgagaucuuucccaaggccaacaguuggccuaaucaugauacaaacaagggggugaccgcugcauguccauaugccggagcuaauuccuucuaccggaaccugauauggcucgucaaaaagggcaauucuuaucccaaauuaagcaaguccuacaucaacaacaaaaagaaggaagugcugguaauuuggggcauccaccacccuccaacgucaacugaccagcaaacccuuuaccagaaugccgaugcguauguuuuuguggggaguagcaaauacucuaagcgcuucaaacccgagauugcagcccgaccuaagguccgugaccaggcuggaagaauggauuauuacuggacauugaucgagccaggugacacuauaaccuuugaagccacaggcaaccugguggugccgagguaugcauucgcuaugaaacggggguccggaucaggcauuaucgucagcgaugcccccguucaugacugcaauaccacgugucagacuccuaagggugcgauuaacacaagucuaccauuucaaaauauccaccccgugaccaucggggagugcccuaaauacguaaagucuacuaagcuccgcauggccacaggacugagaaacauuccauccauacagagcaggggccuuuucggcgcaaucgcuggguuucuggaaggagguuggaccggcaugauugacgggugguauggauaccaucaccagaaugagcagggcucggguuacgccgcugaucaaaaaucuacgcagaacgccaucgacgggauaaccaauaaggugaacuccauuaucgagaaaaugaauacacaguucacugcagucggcaaggaguucucacaguuggagaaacggaucgaaagucucaacaauaagguggaugacggauuucuggauauuuggaccuauaacgccgaguuacugguucuccuugaaaaugagcgcacacuggacuaccacgauagcaacgugaagaacuuguaugaaaaaguccgaucccaacuaaagaauaacgcuaaagagaucggcaauggguguuucgaguuuuaccauaagugcgacaacacuuguauggaaucugugaaaaauggaaccuaugauuaccccaaguauagcgaggaagcgaagcugaacagagaggaaauugacgguguaaaacucgagucagcaaggauauaccagauccuggccauuuacaguacaguugcuuccagccuugugcuguuggucucucucggcgccaucucauucuggaugugcaguaaugggagccugcagugccggaucuguauuuga

SEQ ID NO: 128342 - RNA, 1701 nt, Artificial Sequence; identical to SEQ ID NO: 125849
  derived and/or modified sequence opt3 from hemagglutinin__InfluenzaA__ADV17283

SEQ ID NO: 128343 - RNA, 1701 nt, Artificial Sequence; identical to SEQ ID NO: 125849
  derived and/or modified sequence opt3 from hemagglutinin__InfluenzaA__ADV17293

SEQ ID NO: 128344 - RNA, 1701 nt, Artificial Sequence
  derived and/or modified sequence opt3 from hemagglutinin__InfluenzaA__ADV17303
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccaaagggcugagaaacgugcccucaauucagaguaggggauuguuuggcgcgauagccggcuucaucgaagggggauggacugguauggucgacggcugguacggguaucaucaccagaaugaacaaggaagcggcuacgcagcugaucucaaguccacacagaacgccauugacgagaucaccaauaaagugaacucuguuauagagaagaugaauacgcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauagcaauguaaagaaccuguacgagaaaguucgaucacagcucaagaacaaugcaaaggaaaucggcaacggauguuuugaguucuaucacaaaugcgacaauaccuguauggaaagugugaagaacggcacauacgauuauccuaaauacuccgaggaagccaagcugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 128345 - RNA, 1701 nt, Artificial Sequence; identical to SEQ ID NO: 125849
  derived and/or modified sequence opt3 from hemagglutinin__InfluenzaA__ADV17313

SEQ ID NO: 128346 - RNA, 1701 nt, Artificial Sequence
  derived and/or modified sequence opt3 from hemagglutinin__InfluenzaA__ADV17323
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccaauagcuggcccaaccacgauuccaauaagggugucacggcagccuguccucaugcuggggcaaaaucauuuuauaagaaccugaucuggcucgugaaaaagggaaauaguuacccaaaauuaagcaagucuuauauaaacgacaagggcaaagaaguacugguucuuuggggcauccaccaccccuccacuucagccgaucaacagggguuguaccagaaugcugacgccuacguguucgucggaaccagccgcuauaguaagaaauuuaagccugagauugcgauccgaccaaaagugcgugaucaggaggguagaaugaacuacuauuggacacugguggaacccggcgacaagauuacuuucgaggcaaccgggaaccuagucguuccuagguacgccuuugcuauggaacggaaugccggaucuggcaucauaauuuccgauacaccagugcaugacugcaacaccacgugucaaacuccggagggugcaaucaauacaagccuccccuuccagaacauucacccuaucaccaucgggaaaugcccaaaguauguaaagucgacuaaacugcgccuugcuacaggacugagaaaugugcccucuauucaguccaggggcuuguuuggcgccauagcgggguucaucgaaggagguuggaccggcauggucgacgggugguacggauaucaucaccagaacgagcaaggcucagguuacgccgcagaucucaagaguacgcagaaugcuauugacaaaaucaccaacaaggugaauuacguuauagagaaaaugaacacacaguuuacugccguggggaaggaguucaaucaccuggagaagcggauugaaaacuuaaauaaaaaggucgaugacggcuuccuggauaucuggaccuauaacgcugagcuccuugugcuguuggaaaaugagcgcacacuagacuaccaugauagcaacguaaagaaccuguaugagaagguucgaucccagcucaaaaauaacgccaaggaaaucggaaauggcuguuuugaguucuaccacaagugcgacaacacuuguauggaaucugugaaaaaugggaccuaugauuacccuaaguauagcgaggaagcaaaacugaacagagaggagauugacggagucaaacuugaaucaacaaggaucuaccaaauucuggccauauacaguaccguggcuuccagcuugguccucgugguuucucugggugcgaucucauuuuggaugugcaguaauggcagcuuacagugccggauuuguaucuga

SEQ ID NO: 128347 - RNA, 1701 nt, Artificial Sequence
  derived and/or modified sequence opt3 from hemagglutinin__InfluenzaA__ADV17333
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaacuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguucucagguacgcuuuugccauggaacggaaugcaggguccggaaucauaauuagcgauaccccugugcaugacugcaacacaaccugucaaacgccaaaaggcgcuaucaauacuucgcugccguuccagaacauucaccccaucacaaucgguaagugcccuaaguauguaaaaucuaccaagcugcgccuugccacuggguugagaaaugugccauccauucagucaaggggacucuuuggcgcgauagccggcuucaucgaagggggauggacagguauggucgacggcugguacggguaucaucaccagaacgaacaaggaaguggcuacgcagcugaucugaaaagcacccagaaugccauugacaagaucacgaacaaagugaauaguguuauagagaagaugaacacccaguuuacagcuguggguaaggaguucaaucacuuagaaaaacggauugagaaccugaauaagaaagucgaugacggguuccucgauaucuggacuuacaacgccgaacuucugguguugcuagagaaugaacgcacccuggacuauuacgauucuaacguaaagaaccucuaugagaaaguucgaagccagcugaagaauaacgcaaaggagaucggcaauggauguuuugaguucuaccauaaaugcgacaacacauguauggaaucagugaagaauggcacuuaugauuaccccaaauauagugaagaggccaaacuuaacagagaagagauugacggggucaagcuggaguccaccaggaucuaccaaauuuuggugauauacagcacagucgcuucuucacucgugcugguugugaguuuaggagcgaucagcuuuuggaugugcuccaaugguucucugcagugccggauuuguaucuga

SEQ ID NO: 128348 - RNA, 1701 nt, Artificial Sequence; identical to SEQ ID NO: 124685
  derived and/or modified sequence opt3 from hemagglutinin__InfluenzaA__ADV19019

SEQ ID NO: 128349 - RNA, 1701 nt, Artificial Sequence; identical to SEQ ID NO: 125170
  derived and/or modified sequence opt3 from hemagglutinin__InfluenzaA__ADV41677

SEQ ID NO: 128350 - RNA, 1701 nt, Artificial Sequence
  derived and/or modified sequence opt3 from hemagglutinin__InfluenzaA__ADV58939
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacaccuguauggagucugugaagaaugaaacauacgauuauccuaaauacagcgaggaagcaaagcugaacagagaggagauugacggggucaaacuugaaucaaccaggaucuaucaaauucuggccauauacaguacuguggcuuccagcuugguccucgugguuucucugggagcgaucucauuuuggaugugcaguaaugguagcuuacagugccggauuuguaucuga

SEQ ID NO: 128351 - RNA, 1698 nt, Artificial Sequence
  derived and/or modified sequence opt3 from hemagglutinin__InfluenzaA__ADV69074
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccagacccggagaacggaacuuguuaucccggcuacuuuacagauuaugaggaacugagagagcaacucuccucugugucgucauucaagagguuugaaauuuucccuaaggagagcaguuggccaaaucauaccgucacggguguguccgcuucuugcagccacaacgggaaauccucauuuuaccggaauuuacuguggcuuacuguaaagaacggauuguaucccaaucugaguaaaagcuacaccaacgacaaggagaaagaaguucuagugcucuggggcguccaucacccuccaucuaucggcgaucagcgcacacuguaccacacugagaaugccuauguguccguggucucaagccauuacagucgacguuucacccccgaaauaguuaagagaccuaaggugagggaccaggaggggcggaucaacuauuacuggacacuucuggaaccaggagauaccauuaucugugaggcaaacgguaauuugauugccccgcgcuaugcuuuugcacucucuagaggccugggguccggaaucauaacgagcaacgcccccaugggcgagugcaaugcuaaaugucagacuccucaaggugccauuaacucgucuuuaccauuccagaauguacaccccgugacaaucggggaaugcccuaaguacgucaaauccgcgaagcugaggauggugaccggacuccggaacacuccaucaauucagagucgcggccuuuuuggcgcaaucgccggguucaucgagggagguuggacaggcaugguugacgggugguauggauaccaucaccagaaugaacaaggcagcgguuacgcugccgaucagaaauccacccagaacgcaauuaaugggauaacgaacaaggucaauucugugaucgagaaaaugaacacccaguuuacagcugugggcaaggaguucaauaagcuggaacgaagaauggagaacuugaauaaaaagguagacgauggauuucuagacauuuggacuuauaacgccgaacugcucguucugcuugagaacgaaaggacccuggacuuccacgauagcaaugugaaaaacuuguacgagaaggucaaaucacaacucaagaauaacgcgaaggaaaucggcaauggguguuucgaguuuuaucauaaaugcaacgacgagugcauggaaagugugaagaauggaacauacgauuaucccaaauacuccgaggaaagcaagcugaaccgggagaaaauagacggugucaaguuagagucuauggaaguguaucagauucuggccaucuacucaacuguugcaaguagccuaguguuccucguagcucugggcgccaucuguuuuuggaugugcuccaaugggucucuucaguguaagauuugcaucuga

SEQ ID NO: 128352 - RNA, 1698 nt, Artificial Sequence
  derived and/or modified sequence opt3 from hemagglutinin__InfluenzaA__ADV69075
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccagacccggagaacggaacuuguuaucccggcuacgugacagauuaugaggaacugagagagcaacucuccucugucucgucauuuaagagguucgaaauuuuuccuaaggagagcaguuggccaaaucauaccgugacggguguauccgcuucuugcagccacaacgggaaauccucauucuaccggaauuuacuguggcuuacuguuaagaacggauuguaucccaaucugaguaaaagcuacaccaacgacaaggagaaagaagugcuaguccucuggggcgugcaucacccuccaucuaucggcgaucagcgcacacuguaccacacugagaaugccuauguguccgucguuucaagccauuacagucgacguuuuacccccgaaauagugaagagaccuaagguaagggaccaggaggggcggaucaacuauuacuggacacuucuggaaccaggagauaccauuaucugugaggcaaacgguaauuugauugccccgcgcuaugcuuucgcacucucuagaggcuuuggguccggaaucauaacgagcaacgcccccaugggcgagugcaaugcuaaaugucagacuccucaaggugccauuaacucgucucugccauuccagaaugugcaccccgucacaaucggggaaugcccuaaguacgugaaauccgcgaaguuaaggaugguuaccggacugcggaacacuccaucaauucagagucgcggccucuuuggcgcaaucgccggguucaucgagggagguuggacaggcaugguggacgggugguauggauaccaucaccccaaugaacagggcagcgguuacgcugccgaucaaaaauccacccagaacgcaauuaaugggauaacgaacaaggucaauucugugaucgagaaaaugaacacccaguuuacagcuguaggcaaggaguucaauaaacuugaacgaagaauggagaaccugaauaagaagguugacgauggauuuuuggacauuuggacuuauaacgccgaacuacuggugcuccuggagaacgaaaggacccuugacuuccacgauagcaaugucaaaaaccuguacgagaaggugaaaucacaguugaagaauaaggucaaagaaaucggcaacggguguuucgaguuuuaucauaagugcaaugacgagugcauggaaagugugaaaaacggaacauacgauuauccgaaguacuccgaggaaagcaaacucaaucgggagaagauagacgguguuaagcuggagucuauggaaguguaucaaauuuuagcgaucuacucaacuguagccaguagccuggucuuccuaguggcacucggcgcuaucuguuuuuggaugugcuccaacgggucucugcaguguaaaauuugcaucuga

SEQ ID NO: 128353 - RNA, 1698 nt, Artificial Sequence
  derived and/or modified sequence opt3 from hemagglutinin__InfluenzaA__ADV69077
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccagacccggagaacggaacuuguuaucccggcuacuuuacagauuaugaggaacugagagagcaacucuccucugugucgucauucaagagguuugaaauuuucccuaaggagagcaguuggccaaaucauaccgucacggguguguccgcuucuugcagccacaacgggaaauccucauuuuaccggaauuuacuguggcuuacuguaaagaacggauuguaucccaaucugaguaaaagcuacaccaacgacaaggagaaagaaguucuagugcucuggggcguccaucacccuccaucuaucggcgaucagcgcacacuguaccacacugagaaugccuauguguccguggucucaagccauuacagucgacguuucacccccgaaauaguuaagagaccuaaggugagggaccaggaggggcggaucaacuauuacuggacacuucuggaaccaggagauaccauuaucuuugaggcaaacgguaauuugauugccccgcgcuaugcuuucgcacucucuagaggcuuuggguccggaaucauaacgagcaacgcccccaugggcgaguguaaugcuaaaugccagacuccucaaggugccauuaacucgucucugccauuccagaauguacaccccgugacaaucggggaauguccuaaguacgucaaauccgcgaaguuaaggauggugaccggacugcggaacacuccaucaauucagagucgcggccucuuuggcgcaaucgccggguucaucgagggagguuggacaggcaugguugacgggugguauggauaccaucaccagaaugaacaaggcagcgguuacgcugccgaucagaaauccacccagaacgcaauuaaugggauaacgaacaaggucaauucugugaucgagaaaaugaacacccaguuuacagcugugggcaaggaguucaauaaacuugaacgaagaauggagaaccugaauaagaagguagacgauggauucuuggacauuuggacuuauaacgccgaacuacugguucuccuggagaacgaaaggacccuugacuuucacgauagcaaugugaaaaaccuguacgagaaggucaaaucacaauugaagaauaacgcgaaggaaaucggcaaugggugcuucgaguuuuaucauaaauguaacgacgagugcauggaaagugugaagaauggaacauacgauuaucccaaauacuccgaggaaagcaagcucaaccgggagaaaauagacggugucaagcuggagucuauggaaguguaucagauuuuagccaucuacucaacuguugcaaguagccugguguuccuaguagcucucggcgccaucugcuuuuggauguguuccaaugggucucugcagugcaagauuuguaucuga

SEQ ID NO: 128354 - RNA, 1698 nt, Artificial Sequence
  derived and/or modified sequence opt3 from hemagglutinin__InfluenzaA__ADV69078
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaaagucucaucagcaaaaaguccuggucuuacauuguggagaccccaaauccggaaaacggagcuuguuaucccggcgaguuugccgacuacgaggaacugagagagcaacugucgucaguuagcaguuucgaaagguuugagaucuucccuaaggaguccucuuggccaaaucauacugcagccggugugagcgcuuccugcucacacaacggggagaaaaguuuuuaucggaaucucauaugguuaacaaagaaaaacggacuguaccccaaucuuagcaagucuuaugagaacgauaaagaaaaggaggucuugauccuguggggcgugcaucacccuccaaauauugaaaaccagcgcacccuauaccgaacggagaacgcauacguauccguugugucaagccacuauaguggccguuucacucccgagaucaccaagagaccuaaagucaggaaucaggaagggcggauuaacuacuauuggacacuccuggagccaggagacacuaucauauuugaagccaaugguaaccuuauugcuccgugguacgccuucacccugucucgcggcuugggguccggaaucauuacaagcaaugcgcccauggaugagugugacgcaaagugccagaccccucaaggcgccaucaacucgucucucccauuucagaaugugcaucccgugacgaucggugaauguccuaaauaugucagauccucaaagcugaggaugguuacuggguuacggaacauuccaaguauacagagccgcggacuguucggcgcuaucgccggcuuuauugaagggggauggacagguaugguggauggcugguacggguaucaccaucagaaugagcaaggauccggcuacgcagcugaccaggaaucuacccagaacgccaucaaugguauaacuaacaaaguaaauagcgugauugagaagaugaacacacaguucaccgcggucgggaaagaauuuaauaagcucgagcgaagaauggaaaaccuuaacaagaaaguggaugacggcuuccuggauaucuggacguacaaugccgaguugcuaguucugcucgagaacgaaaggacccuggacuuccacgacucaaaugugaagagucuuuaugagaaagucaagucccaacugaaaaacaaugcaaaggaaaucggaaacggcugcuuugaguucuaccacaaguguaauaacgagugcauggaaagcgugaaaaaugggacauaugauuaccccaaguauucugaggaaucaaaauugaaccgggagaagauugacggaguaaaacucgauaguauggguguuuaccguauccuggcuauuuauagcacuguggccuccucuuuaguccugcuagugucgcucggcgcuaucagcuuuuggaugugcuccaaugggucacugcagugucgcauaugcauuuga

SEQ ID NO: 128355 - RNA, 1698 nt, Artificial Sequence
  derived and/or modified sequence opt3 from hemagglutinin__InfluenzaA__ADV69079
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaaaagagcugguccuacauugugaagaccccaaauccggagaacggaucuuguuaucccggcuacuuugcugacuaugaagaacugagagagcaacucucgucaguuagcaguuucgaaagguuugagauguucccuaaagaauccucuuggccaaaucauaacgugaauggugucagcgccuccugcucacacaacgggaagcggaguuuuuaccgcaauuuacuguggcuuacuggcaaaaacggauuguaucccaaucugacaaagagcuacgagaacaacaaugagaaagaagugcuaauccucuggggcguacaucacccuucuaacauaggggaucagcgaacccuguaccacacggagaaugcauauguuuccgugaugucaagccauuacagucguagauucacuccagaaaucaacaagaggcccaagguccgggaccaggagggacgcauuaauuauuacuggacccuucuggaaccuggugauacaaucauuuuugaggccaacggcaauuugaucgcuccaugguaugcauucgcccucucuagaggguuuggauccggcauaauuacuagcucggcuccgauggacgagugugaugccaaaugccagacccccaggggugcgaucaacucuucccugccuuuccaaaaugugcacccagugacaauuggggaaugucccaaguacguccggucagcaaaauuacgcaugguuaccggacugcgaaacaucccuaguauccagagcagaggccucuuuggcgccauugcuggguucauagagggagguuggacgggcaugguggacgggugguauggauaccaucaccagaaugaacagggcuccgguuacgccgcagaucaagagucuacucagaacgcuaucaaugggauuacaaacaagguaaauagcgugaucgagaaaaugaacacccaguuuacugccgucggcaaggaguucaacaaacuugagaggcggauggaaaaucugaacaagaagguggacgauggauucuuggacauauggacauauaaugcggagcuacugguucuccuggaaaacgagcguacccuugacuuucacgauucaaaugugaaaagucuguacgaaaaggucaaaucccaguugaagaacaaugccaaagagauuggcaacgggugcuucgaguuuuaucauaaguguaauaacgaaugcauggagagcgugaagaauggaacguacgacuauccaaaauacucugaagagucaaagcucaaccgcgagaaaaucgaugguguaaagcuggacaguaugggcguuuaucaaaucuuagcaauuuacagcaccguggcuuccucucugguccuacucgugucgcugggggccaucagcuucuggaugugcuccaauggaucacuucaguguagaauuugcauauga

SEQ ID NO: 128356 - RNA, 1698 nt, Artificial Sequence
  derived and/or modified sequence opt3 from hemagglutinin__InfluenzaA__ADV69080
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaaagucucaucagcaaaaaguccuggucuuacauuguggagaccccaaauccggaaaacggagcuuguuaucccggcgaguuugccgacuacgaggaacugagagagcaacugucgucaguuagcaguuucgaaagguuugagaucuucccuaaggaguccucuuggccaaaucauacugcagccggugugagcgcuuccugcucacacaacggggaacggaguuuuuaucgcaaucucauaugguuaacaaugaaaaacggacuguaccccaaucuucgaaagagcuaugagaacgauaaagaaaaggaggucuugauccuguggggcgugcaucacccuccaaauauugaaaaccagcguacccuauaccacacggagaacgcauacguaucuguuguguccucacauuauagcggcagauucacucccgagaucaccaaaaggccuaagguccgggaccaggaagggcgcauuaauuacuauuggacacuccuggagccaggagauacuaucauauuugaagccaacgguaaucuuauugcuccgugguacgccuucacccugaguagaggcuuggggucuggaaucauuacauccaacgcgcccauggacgcaugugaugccaagugccagaccccucaaggcgcuaucaauagcucgcucccauuucagaacgugcaccccgugacgaucggugaguguccuaaauaugucaggucugccaagcugcggaugguuacuggguuacgcaauauuccauccauacagucacgaggacuguucggcgcaaucgcuggcuuuauugaagggggauggacagguaugguggacggcugguacggguaucaucaccagaacgagcaaggaaguggcuacgccgcggaucaggagagcacccagaaugccaucaacgguauaacuaauaaaguaaacuccgugauugaaaagaugaauacacaguucaccgcagucgggaaagaguuuaacaagcucgaaagaaggaucgagaaucuuaacaaaaagguggacgauggcuucaucgacauuuggacguacaacgcugaacuguugguucuacuggagaaugagcggacccucgacuuccacgauucuaacgucaagagccuguaugaaaaagugaagucacaacuuaaaaauaacgccaaggagaucggaaauggcugcuuugaguucuaccauaaauguaacaaugaaugcauggagagugugaagaacgggacauaugacuaccccaaguauuccgaagagagcaaacugaaucgugaaaagauugauggaguaaaauuggacucuauggguguuuaccgcauacucgcuaucuauucaacuguggccaguagccuggucuuacuggugucccuaggcgcaauuucuuuuuggaugugcucgaacgggagccuccaguguagaaucugcaucuga

SEQ ID NO: 128357 - RNA, 1698 nt, Artificial Sequence
  derived and/or modified sequence opt3 from hemagglutinin__InfluenzaA__ADV69081
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccaaacccggagaauggaacuuguuaucccggcuacuuuacagacuaugaggaacugagagagcaacucuccucugugucgucauucaagagguuugaaauuuucccuaaggagagcaguuggccaaaccauaccgucacggguguguccgcuucuugcagccacaauggggaguccucauuuuaccggaacuuacuguggcuuacugugaaaaauggauuguaucccaagcugaguaaaagcuacaccaacgauaaggaaaaagagguucuagugcucuggggcguccaucacccuccaaauauccgcgaccagcgaacacuguaccacacugaaaacgccuaugugucuguggucuccucacauuacagccguagauucacccccgagauaguuaagaggccuaaggugcgggaucaggaaggccgcaucaacuauuacuggacacuucuggagccaggggacaccauuaucuuugaggcaaauggaaacuugauugccccgagauaugcuuucgcacucaguagggguuuuggcucugggaucauaacguccaaugcccccaugggagaauguaacgcuaaaugccagacuccucaaggcgccauuaucagcucgcugccauuccagaauguacaccccgugacaauuggugaguguccuaaguacgucaaaucugcgaaguuacggauggugaccgggcugcgcaacacuccauccauccagucacgaggacucuuuggcgcaaucgccggcuucauugaagggggauggacagguaugguugauggcugguauggguaccaucaccagaaugagcaaggaaguggcuacgcugccgaccagaaaagcacccagaacgcaauaaaugguaucacgaacaagguaaauuccgucauugaaaagaugaacacccaguuuacagcuguggggaaggaguucaauaaacuugagagaaggauggaaaaccugaauaaaaagguagaugacggcuucuuggauaucuggacuuauaacgccgagcuacugguucuccuggaaaacgagcggacccuugacuuucacgacucuaaugugaaaaaccuguacgaaaaggucaaaagccaauugaagaauaacgcgaaggagauaggaaauggcugcuucgaguuuuaucauaaauguaacgaugaaugcauggagucagugaagaaugggacauacgacuaucccaaauacagugaagaguccaagcucaaccgugagaaaauugauggagucaagcuggaaagcauggagguguaucagaucuuagccaucuacucuacuguugcaucaagucugguguuccuaguagcucucggugccauuugcuuuuggauguguagcaauggcucccugcagugcaagaucuguauuuga

SEQ ID NO: 128358 - RNA, 1698 nt, Artificial Sequence
  derived and/or modified sequence opt3 from hemagglutinin__InfluenzaA__ADV69083
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaaugugaccgguguaagcuccucaugcagucacaacgggaaaagcucuuuuuaccggaaucucuuauggcugacgguuaagaacggacuuuaucccaauuuguccaaaucauacacuaacaagaaagagaaggaagugcugguccuauggggcgugcaucacccuagcaauauuggcgaucagcgcgcucucuaccacaccgagaacgccuaugugagugucguuucuucccauuacagccgacguuucacaccagaaaucgcaaagagacccaaagugaggaaccaggaggggcggauaaauuauuacuggacucugcuugaaccuggagacaccaucauucuggaggccaacgguaauuugaucgcuccacgcuaugcauuugagcucucgaagggccuggggucuggaauuaucacauccaacgccccgaugggcgaauguaaugcuaaaugccagacgccccaaggugccauaaacucaaguuuaccuuuccagaauguacacccagugaccauuggggagugucccaaguacgucaaaagcgcgaagcugagaauggugacuggacucaggaacacaccuuccauccagucucggggccuuuuuggcgcaauugccggguucaucgaaggagguuggaccggcaugguugaugggugguauggauaccaucaccagaaugagcaaggcagcgguuacgcugccgaccagcagucaacucagaacgcaaucaaugggauuacaaacaaagugaauagugucauagaaaagaugaacacccaauuuacggcugugggcaaggaguucaauaaacuggagcgccgaauggaaaacuugaacaagaaaguagaugacggauuucuagauaucuggaccuauaaugccgagcugcucguucugcuugaaaacgagagaacacuggacuuccacgauuccaaugugaagaacuuguacgaaaaagucaagagccagcucaagaauaacgcgaaagagauuggcaaugggugcuucgaguuuuaucauaaguguaacgacgaaugcauggagucugugaaaaauggaacuuacgacuauccaaaguacucagaagagaguaaacugaacagggagaagaucgauggugucaaguuagaaagcaugggcguguauaauauacuggccauuuacuccaccguugcaucuucgcuagugcuccugguaagccuuggggcuaucuccuucuggaugugcucaaacggaaguuugcagugucggaucugcauuuga

SEQ ID NO: 128359 - RNA, 1698 nt, Artificial Sequence
  derived and/or modified sequence opt3 from hemagglutinin__InfluenzaA__ADV69084
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaaugugaccgguguaagcuccucaugcagucacaacgggaaaagcucuuuuuaccggaaucucuuauggcugacgguuaagaacggacuuuaucccaauuuguccaaaucauacacuaacaagaaagagaaggaagugcugauucuauggggcguccaucacccuagcaauauccgcgaucagcgagcucucuacuauaccgagaacgccuacgugaguguggucucuucccacuauagccguagauucacaccagaaauagcaaagaggcccaaaguucggaaccaggagggccgcaucaauuacuauuggacucugcuugaaccuggggacaccauuaucuuugaggccaacggaaaucugauugcuccaagauacgcauucgaguugucgaaggguuuuggcucugggaucauaacauccgaugccccgaugggagaauguaacgcuaaaugccagacgccccaaggcgccauuaauucaagucucccuuuccagaacgugcauccaguaaccaucggugagugucccaaguaugugaggagcgcgaaacugcggauggucacuggguuacgcaauacaccuuccauucagucucgaggacuguuuggcgcaaucgccggcuucaucgaagggggauggaccgguaugguggacggcugguacggguaccaccaucagaacgagcaaggaagcggcuaugcugccgaucagcagucaacucagaaugcaauuaacgguauaacaaauaagguuaacagugugaucgaaaagaugaauacccaauuuacggcugucgggaaagaguucaacaagcucgagagaaggauggaaaaucuuaacaaaaagauugacgauggcuuccuggacaucuggaccuacaacgccgaguugcuagugcugcucgaaaaugagcggacacuggauuuucacgacuccaacguuaaaaaucuuuaugaaaagguaaaaagccagcugaagaacaaugcgaaggagauaggaaacggcugcuucgaguuuuaccacaaauguaaugacgaaugcauggagucugugaagaacgggacuuaugauuacccaaaauauucagaagagaguaaguugaaucgugagaaaauugacggagucaagcucgaaagcauggguguguacaacauccuggccaucuacuccaccgucgcaucuucguuagugcugcuaguuagccucggcgcuauuuccuucuggaugugcucaaaugggagucugcagugucgcaucugcauuuga

SEQ ID NO: 128360 - RNA, 1698 nt, Artificial Sequence
  derived and/or modified sequence opt3 from hemagglutinin__InfluenzaA__ADV69085
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaccgugacggguguaagcuccucaugcagucacaaugggaaaagcucuuuuuaccggaaccucuuauggcugacuaugaagaauggacuuuaucccaacuuguccaaaucauacaccaauaagaaagagaaggaaguucuggugcuauggggcguccaucacccuagcaacauuggcgaucagcgcgcucucuaccacacagagaaugccuaugugaguguggucucuucccauuacagccgacguuucacuccagaaaucgcaaagagacccaaaguuaggaaccaggaggggcggauaaacuauuacuggacccugcuugaaccuggagacacaaucauuuuugaggccaaugguaaccugaucgcuccacgcuaugcauucgaguugucgaagggcuuugggucuggaauuaucaccuccaaugccccgaugggcgaauguaacgcuaaaugccagacgccccaaggugccauaaauucaagucucccuuuccagaacgugcacccaguaacuauuggggagugucccaaguacgugagaagcuccaaacugaggauggucacaggauuacggaauaccccuucuauccagagccgcggccuguuuggcgcgauugcaggguucaucgaaggagguuggacuggcaugguggaugggugguauggauaccaucaccagaacgagcaaggcucagguuacgccgcugaccagcagaguacacagaaugccaucaacgggauuaccaauaagguuaacuccgugauagaaaagaugaauacgcaauuuaccgcagucggcaaagaguucaacaagcucgagcgaagaauggaaaaucuuaacaaaaagaucgaugacggauuccuggauauuuggacauauaacgcugaguugcuagugcugcucgaaaaugagaggacucuggacuuucacgauagcaacguuaaaaaucuuuacgaaaagguaaaaucucagcugaagaacaaugccaaggagaucggcaacgggugcuucgaguuuuaucauaaauguaaugacgaaugcauggagucagugaagaacggaaccuacgacuauccaaaauacagugaagagagcaaguugaaucgggagaaaauagauggugucaagcucgaauccaugggcguguauaacauucuggcgaucuacucuacagucgccucgagcuuagugcugcuaguuucccucggggcaaucucauucuggaugugcaguaauggaucucugcagugucguauuugcaucuga

SEQ ID NO: 128361 - RNA, 1698 nt, Artificial Sequence
  derived and/or modified sequence opt3 from hemagglutinin__InfluenzaA__ADV69086
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccaaacccggagaauggaacuuguuaucccggcuacuuuacagacuaugaggaacugagagagcaacucuccucugugucgucauucaagagguuugaaauuuucccuaaggagagcaguuggccaaaacauaccgucacggguguguccgcuucuugcagccacaacgggaaguccucauuuuaccggaauuuacuguggcuuacuggaaagaacggcuuguaucccaaucugaguaagagcuacaccaacgauaaagagaaggaaguucuaguacucuggggcgugcaucacccuucuaauaucggggaccagcgcgcccuguaccacaaggagaacgcauaugucuccguggugucaagccauuacagucgacguuucacaccagaaauagucaaaagacccaagguuagggaucaggagggacggaucaacuauuacuggacucuucuggaaccuggugacaccauuaucuuugaggccaauggcaacuugauugcuccacgcuaugcauucgcccucucuagaggguuuggauccggcaucauaacaagcaaugcuccgauggaugaguguaacaccaaaugccagacgccccaaggugccauuaauucgucucugccuuuccagaacgugcacccaguaacuaucggggaaugucccaaguacgugaaauccgcgaaguuaaggauggucacaggacugcggaauaccccuucaauucagagucgcggccucuuuggcgcaaucgccggguucaucgagggagguuggacuggcaugguggacgggugguauggauaccaucaccagaacgaacaaggcagcgguuacgcugccgaucagaaauccacacagaaugcaauuaacgggauaaccaauaagguuaacucugugaucgagaagaugaauacgcaguuuaccgcugucggcaaagaguucaacaaacuugaacgaagaauggagaaucugaacaaaaagguggacgauggauucuuggacauuuggacauauaacgccgaacuacugguacuccuggagaaugaaaggacucuugacuuucacgauagcaacguuaaaaaucuguacgagaaggugaagucacaauugaaaaacaaugcgaaggaaaucggcaacgggugcuucgaguuuuaucauaaauguaaugacgagugcauggaaagugucaagaacggaaccuacgauuauccaaaauacuccgaggaaagcaagcucaaucgggagaagauagacggugugaaacuggagucuauggaagucuaucagauuuuagccaucuacucaacaguggcaaguagccugguuuuccuagugucccucggcgcuaucugcuuuuggauguguucuaacgggucgcugcagugccguauuuguaucuga

SEQ ID NO: 128362 - RNA, 1698 nt, Artificial Sequence
  derived and/or modified sequence opt3 from hemagglutinin__InfluenzaA__ADV69087
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaccgugaaugguguaagcuccucaugcagucacaacggggagagcucuuuuuaccggaaucucuuauggcugacgguuaaagauggacuuuaucccaacuuguccaagucauacacuaauaaaaaggaaaaagaggugcugguccuauggggcgugcaucacccuagcaacauuggcgaccagcgcgcucucuaccacaccgaaaaugccuaugugagugucguuucuucccauuacagccgacguuucacaccagagaucgcaaagagacccaaggugaggaaccaggaagggcggauaaacuauuacuggacucugcuugagccuggagauaccaucauuuuugaggccaaugguaaccugaucgcuccacgcuaugcauucgaauugucgaaaggcuuugggucuggaauuaucacauccaaugccccgaugggcgaguguaacgcuaagugccagacgccccaaggugccauaaauucaagucucccuuuccagaacguacacccagugaccauuggggaaugucccaaauacgucagaagcacuaagcugaggauggugacaggauuacggaauaccccuuccauccagucucgcggccuguuuggcgcgauugcaggguucaucgagggagguuggacuggcaugguugacgggugguauggauaccaucaccagaacgaacaaggcagcgguuacgccgcugaucagcagucaacacagaaugccaucaacgggauuaccaauaaagugaacagugucauagagaagaugaauacgcaauuuaccgcagugggcaaagaguucaacaagcucgaacgaagaauggagaaucuuaacaagaaaaucgacgauggauuccuggacauuuggacauauaacgcugaauugcuaguacugcucgagaaugaaaggacucuggauuuucacgacuccaacguuaagaaucuuuacgagaaagucaagagccagcugaaaaacaaugccaaggagaucggcaacgggugcuucgaauuuuaucauaaguguaaugacgagugcauggaaucugugaaaaacggaaccuacgauuauccaaaguacucagaggagaguaaauugaaucgggaaaagauagacggugugaaacucgagagcaugggcgucuauaacauucuggcgaucuacuccacaguggccucuucguuaguucugcuagugagccucggggcaaucuccuucuggaugugcucaaauggaagucugcagugucguauuugcaucuga

SEQ ID NO: 128363 - RNA, 1698 nt, Artificial Sequence
  derived and/or modified sequence opt3 from hemagglutinin__InfluenzaA__ADV69088
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucaccggcuggauuuuggggaacccugagugcgaacuccugaucaguaaaaagagcugguccuacauuguggagacuccaaauccggaaaacggagccuguuaucccggcuacuuugcugacuaugaggagcugagagaacaacucucuucgguuagcagcuucgagagguuugaaaucuucccuaaggagaguuccuggccaaaucauaacgugaauggugucucugccagcugcucccacaacgggaaaucaaguuuuuaccggaauuuacuguggcuuacaggaaagaacggcuuguaucccagccugaccaaaucuuacgcaaaugauaaggagaaagaagugcuaauacucuggggcguacaucacccuuccaacaucggggaccagcgcacgcuguaccacacugagaacgccuauguuucagugaugagcagucauuacucucgacguuucaccccagaaauuuccaagagacccaaggucagggaucaggagggacggaucaauuauuacuggacacuucuggaaccuggugacacuauuaucuuugaggcuaacggcaauuugauagcaccaugguaugccuucgcucucagccgcggguuuggaucgggcauuaucaccucuuccgccccgauggaugcgugugacgcaaaaugccagacaccccaaggugccauuaacucaagucugccuuuccagaaugugcacccagugaccaucggggagugucccaaguacgucagaagcacgaaauuaaggaugguuacuggacugcggaacaucccuuccauucagucucgcggccucuuuggcgcuauagccggguucaucgaaggagguuggacaggcaugguggaugggugguauggauaccaucaccagaaugagcaaggcagcgguuacgcagcugaccaggaaucaacccagaacgcccuucacgggauuacuaauaagguaaacagugugaucgagaaaaugaauacacaguuuaccgcggucggcaaggaguucaacaaacuggaacgaagaauggagaauuugaacaagaagguggaugacggauuccuagacauauggacguauaaugccgaacugcucguucugcuugagaacgaaaggacccuggauuuucaugacuccaacgugaaaucauuguacgagaaggucaaaauucaacucaagaauaacgcaaaagaaaucggcaaugggugcuucgaguuuuaucacaaguguaacaaugagugcauggaaucugugcggaacggaacauacgauuauccaaaguacucagaggaaaguaaacugaaucgugagaagaucgacgguguaaaauuagauagcaugggcguuuaucagauucuggcuaucuacuccacuguggccucuucgcuaguccuccuggugagccuuggggcuauuuccuucuggaugugcucaaacggaaguuugcagugucgcauaugcaucuga

SEQ ID NO: 128364 - RNA, 1698 nt, Artificial Sequence
  derived and/or modified sequence opt3 from hemagglutinin__InfluenzaA__ADV69089
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaaaagagcugguccuacauuguggagaccccaaauccggaaaacggagcuuguuaucccggcuacuuugccgacuaugaggagcugagagaacaacucucuucgguuagcucauucgagagguuugaaaucuucccuaaggagaguuccuggccaaaucauaacgugaauggugucucugcaagcugcucccacaacgggaaaucaaguuuuuaccggaauuuacuguggcuuacuggaaagaacggcuuguaucccaaucugacaaaaagcuacgccaacaacaaggagaaagaagugcuaauacucuggggcguacaucacccuucuaauaucggggaucagcgcacccuguaccacacggagaacgcuuauguuuccgugaugucaagccauuacagucgacguuucacuccagaaauuaccaagagacccaagaucagggaccaggagggacggauuaauuauuacuggacacuucuggaaccuggugauacuaucauauaugaggcaaacggcaauuugauugccccaugguacgcuuuugcccucucucgcggguucggauccggcaucauuaccagcucggcgccgauggacgagugugaugcaaaaugccagacaccccaaggugccaucaacucuucccugccuuuucagaauguccacccagugaccaucggggaaugucccaaguaugugagaucagcuaaauuaaggauggucacgggacugcggaacauuccuaguauacagagccgcggccucuucggcgccaucgcaggguuuauugagggagguuggacuggcaugguuaaugggugguacggauaccgacuucauaacgaccagggcuccgguuaugcugccgaucaaaagucuacacagaaugcgcugaacgggaucaccaauaaagugaacagcguaauagaaaagaugaauacucaguucacagccgugggcaaagaguuuaacaaguuggaaagaaggauggagaaccuaaauaagaaagucgacgauggauuccuggacauuuggaccuacaacgcagagaugcucgugcugcuugaaaaugagcggacgcuggacuuccacgauucaaacguuaagaguuuguaugaacgugugaaaauccagcucaagaauaacgcuaaagagaucggcaaugggugcuuugaguucuaccacaaguguaacaaugaaugcauggaguccguccgcaacggaaccuaugacuacccaaaguauagcgaagagucuaaacugaauagagaaaagauugauggugugaaauuagacucaaugggcguauaccaaauccuggccauuuacaguacaguugcuagcucccuagugcuccuggucucucuuggggccauaucguuuuggaugugcagcaacggauccuugcaguguaggaucugcauuuga

SEQ ID NO: 128365 - RNA, 1698 nt, Artificial Sequence
  derived and/or modified sequence opt3 from hemagglutinin__InfluenzaA__ADV69090
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcaaagaguccuggucuuacaucguugaaaccccaaauccggagaacggaacuuguuaucccggcuacuuugcugacuaugaggaacugagagagcaacugucgucagugagcaguuucgaaagguuugagauuuucccuaaggaguccucuuggccaaaucauacagucaccggugugagcgccuccugcucacacaacgggaagaguagcuuuuaccggaaucucuuauggcugacgcgcaaaaacggacuuuaucccaauuugucuaaguccuacgcaaacaauaaagaaaaggagguacugguucuauggggcgugcaucacccuccaaaccucggcgaucagcgagcccuguaccacacugaaaacgcuuaugucucaguggugagcagucauuacucucguagauucacccccgagaucgcaaaaaggccuaagguccgggaccaggaagggcgcauaaauuauuacuggacacuucuggagccaggagauacuaucauuuuugaggccaacgguaauuugaucgcuccgagauucgccuuugcgcucuccaggggcuucgggagcggaauuaucaccucgaacgcacccauggacgaaugugaugccaagugccagacaccucaaggcgcuauaaauucuucccugccauuucagaacguucaccccgugaccauuggugaguguccuaaauauguacggucaacgaaguuacgcauggugacugggcugcgaaauaucccaaguauucagagcagaggacucuucggcgccaucgcaggcuuuaucgaagggggauggacagguauggucgacggcugguacggguaucaucaccagaacgagcaaggauccggcuacgcugccgaucagaaaucuacccagaaugcgauuaacgguauaacuaauaaggugaacagcguuaucgaaaagaugaauacacaguucaccgccguggggaaagaguucaacaaacuugagaggcggauggaaaaucugaacaagaaggucgacgauggcuuuuuggacauuuggacguacaacgcagagcuacuggugcuccuggaaaaugagcguacccuugacuuccacgauucaaacguuaaaaaucuguaugaaaagguaaaaagucaauugaagaacaaugcuaaagagaucggaaacggcugcuuugaguucuaccauaaguguaaugacgaaugcauggaguccgugaagaacgggacauaugauuaccccaaauauagcgaagagucuaagcucaaucgcgagaaaauagacggagucaagcuggaaucaauggguguguaccagauuuuagccaucuauaguacugucgcuagcucccuggugcuacucguuucucugggcgccaucucguuuuggaugugcagcaacgggucccuucaguguagaauuugcaucuga

SEQ ID NO: 128366 - RNA, 1698 nt, Artificial Sequence
  derived and/or modified sequence opt3 from hemagglutinin__InfluenzaA__ADV69091
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccaaacccggagaauggaacuuguuaucccggcuacuuuacagacuaugaggaacugagagagcaacucuccucugugucgucauucaagagguuugaaauuuucccuaaggagagcaguuggccaaaccauaccgucacggguguguccgcuucuugcagccacaaugggaaauccucauuuuaccggaacuuacuguggcuuacucgcaagaauggauuguaucccaaccugaguaaaagcuacaccaaugauaaggagaaagaaguucuaguacucuggggcgugcaucacccuucuaacaucggcgaccagcgagcccuguaccacaaggagaacgcauaugucuccguggugucaagccauuacagucguagauucacaccagaaauagucaagaggcccaaaguucgggaucaggaggggcgcaucaauuauuacuggacucuucuggaaccuggagacaccauuaucuuugaggccaacgguaauuugauugcuccaagauaugcauucgcccucucuaggggcuuuggguccggaaucauaacaagcaacgcuccgauggaugaguguaauaccaagugccagacgccccaaggcgccauuaacucgucucugccuuuccagaaugugcacccaguaacuaucggugaaugucccaaauacgugaaguccgcgaaauuacggauggucacagggcugcgcaacaccccuucaauucagagucgaggacucuuuggcgcaaucgccggcuucaucgaagggggauggacugguaugguggacggcugguauggguaccaucaccagaaugaacaaggaagcggcuacgcugccgaucagaaguccacacagaacgcaauuaaugguauaaccaacaaaguuaauucugugaucgagaagaugaacacgcaguuuaccgcugucgggaaggaguucaauaaacuugagagaaggauggagaaccugaacaagaaaguggacgauggcuucuuggacauuuggacauauaaugccgaacuacugguacuccuggagaacgaacggacucuugacuuucacgauagcaauguuaagaaccuguacgagaaagugaagaaucaauugaagaacaaugcgaaagaaaucggaaacggcugcuucgaguuuuaucauaaguguaaugacgagugcauggaaucagucaaaaacgggaccuacgauuauccaaaguacagugaggaauccaaacucaaucgugagaagauagacggagugaagcuggagagcauggaagucuaucagauuuuagccaucuacucuacaguggcaucaagucugguuuuccuagugagccucggugcuaucugcuuuuggauguguuccaacggcucucugcagugccgcauuuguaucuga

SEQ ID NO: 128367 - RNA, 1698 nt, Artificial Sequence
  derived and/or modified sequence opt3 from hemagglutinin__InfluenzaA__ADV69092
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguaacguggccggcuggaucuuggggaauccugagugcgaacuccugauuucaaaagagaguuggagcuacaucguugaaaccccaaacccggagaauggaacuuguuaucccggcuacuuuacagacuaugaggaacugagagagcaacucuccucugugucgucauucaagagguuugaaauuuucccuaaggagagcaguuggccaaaccauaccgucacggguguguccgcuucuugcagccacaaugggaaauccucauuuuaccggaacuuacuguggcuuacuggaaagaauggcuuguaucccaaccugaguaaaagcuacaccaaugauaaggagaaagaaguucuaguacucuggggcgugcaucacccuucuaacaucggggaccagcgcgcccuguaccacaaggagaacgcauaugucuccguggugucaagccauuacagucgacguuucacaccagaaauagucaagagacccaaaguuagggaucaggagggacggaucaauuauuacuggacucuucuggaaccuggugacaccauuaucuuugaggccaacggcaauuugauugcuccacgcuaugcauucgcccucucuagaggguuuggauccggcaucauaacaagcaacgcuccgauggaugaguguaauaccaagugccagacgccccaaggugccauuaacucgucucugccuuuccagaaugugcacccaguaacuaucggggaaugucccaaauacgugaaguccgcgaaauuaaggauggucacaggacugcggaacacccucucaauucagaguaagggccuuuuuggcgcaaucgccggguucaucgagggagguuggacuggcaugguggacgggugguauggauaccaucaccagaaugaacaaggcagcgguuacgcugccgaucagaaauccacacagaacgcaauuaaugggauaaccaacaagguuaauucugugaucgagaagaugaacacgcaguuuaccgcugucggcaaagaguucaauaagcuggaacgccgaauggagaacuugaacaaaaagguggacgauggauuccuagacauuuggacauauaaugccgaacugcucguacugcuugagaacgaaagaacucuggacuuucacgauagcaauguuaaaaacuuguacgagaaggugaagucacaacucaaaaauaacgcgaaggaaaucggcaaugggugcuucgaguuuuaucauaaauguaacgacgagugcauggaaagugucaagaauggaaccuacgauuauccuaaauacuccgaggaaagcaagcugaacagggagaagauagacggugugaaauuagagucuauggaagucuaucagauucuggccaucuacucaacaguggcaaguagccuaguuuuccucgugucccugggcgcuaucugcuuuuggauguguucuaaugggucgcuucagugccggauuuguaucuga

SEQ ID NO: 128368 - RNA, 1698 nt, Artificial Sequence
  derived and/or modified sequence opt3 from hemagglutinin__InfluenzaA__ADV69093
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacgucacagacuaugaggaacugagagagcaacugucgucagugagcaguuuuaagagguucgaaaucuuuccuaaggaguccucuuggccaaaccauaccguaacggguguuagcuccucaugcagucacaaugggaaaagcucuuucuaccggaaccucuuauggcugacugugaagaauggacuuuaucccaacuuguccaaaucauacaccaauaagaaagagaaggaaguccuggugcuauggggcgugcaucacccuagcaacauuggcgaucagcgcgcucucuaccacacagagaaugccuaugucaguguugugucuucccauuacagccgacguuuuacuccagaaaucgcaaagagacccaaaguaaggaaccaggaggggcggauaaacuauuacuggacccugcuugaaccuggagacacaaucauuuucgaggccaaugguaaccugaucgcuccacgcuaugcauuugaguugucgaagggcuucgggucuggaauuaucaccuccaaugccccgaugggcgaauguaacgcuaaaugccagacgccccaaggugccauaaauucaagucucccuuuucagaacgugcacccagucacuauuggggagugucccaaguacgugaaaagcgcgaagcugagaaugguuacaggauuaaggaauaccccuuccauccagucucggggccuguucggcgcaauugccggguuuaucgaaggagguuggacuggcaugguggaugggugguauggauaccaucaccagaacgagcaaggcagcgguuacgcugccgaccagcagucaacacagaaugcaaucaacgggauuaccaauaaagucaacagugugauagaaaagaugaauacgcaauucaccgcuguaggcaaggaguuuaacaaacucgagcgccgaauggaaaaucuuaacaagagaguugaugacggauuccuggauaucuggacauauaacgccgaguugcuagugcugcucgaaaaugagaggacucuggacuuccacgauuccaacgucaaaaaucuuuacgaaaaggugaaaagccagcugaagaacaaugcgaaggagauuggcaacgggugcuuugaguucuaucauaaauguaaugacgaaugcauggagucugucaagaacggaaccuacgacuauccaaaauacucagaagagaguaaguugaaucgggagaaaaucgauggugugaagcucgaaagcaugggcguuuauaacauacuggccauuuacuccacaguggcaucuucguuaguacugcuagucagccucggggcuaucuccuuuuggaugugcucaaauggaagucugcagugucguaucugcauuuga

SEQ ID NO: 128369 - RNA, 1698 nt, Artificial Sequence
  derived and/or modified sequence opt3 from hemagglutinin__InfluenzaA__ADV69094
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaccgugacggguguaagcuccucaugcagucacaaugggaaaagcucuuuuuaccggaaccucuuauggcugacuguuaagaauggacuuuaucccaacuuguccaaaucauacaccaauaagaaagagaaggaagugcugguccuauggggcgugcaucacccuagcaacauuggcgaucagcgcgcucucuaccacacagagaaugccuaugugagugucguuucuucccauuacagccgacguuucacuccagaaaucgcaaagagacccaaagugaggaaccaggaggggcggauaaacuauuacuggacccugcuugaaccuggagacacaaucauuuuugaggccaaugguaaccugaucgcuccacgcuaugcauucgaguugucgaagggcuuugggucuggaauuaucaccuccaaugccccgaugggcgaauguaacgcuaaaugccagacgccccaaggugccauaaauucaagucucccuuuccagaacguacacccagugacuauuggggagugucccaaguacgucaaaagcgcgaagcugagaauggugacaggauuaaggaauaccccuuccauccagucucggggccuguuuggcgcaauugccggguucaucgaaggagguuggacuggcaugguucaugggugguauggauaccaccaccagaacgagcaaggcagcgguuacgcugccgaacagcagucaacacaguaugcaaucaaugggauuaccaacaaagugaauagugucauagagaagaugaacacgcaauuuaccgcugugggcaaggaguucaauaaacucgaacgccgaauggagaaccuuaauaagagaguagaugacggauuccuggauaucuggacauacaacgccgaauugcuaguucugcucgagaacgaaaggacucuggacuuucaugauuccaaugugaaaaaccuuuaugagaaggucaaaagccagcugaagaauaacgcgaaggagauuggcaaugggugcuucgaauuuuaccacaaauguaacgacgagugcauggaaucugugaagaauggaaccuaugauuacccaaaauauucagaggagaguaaguugaaccgggagaaaaucgacggugucaagcucgaaagcaugggcguguacaauauacuggccauuuacuccacaguugcaucuucguuagugcugcuaguaagccucggggcuaucuccuucuggaugugcucaaacggaagucugcagugucguaucugcauuuga

SEQ ID NO: 128370 - RNA, 1698 nt, Artificial Sequence
  derived and/or modified sequence opt3 from hemagglutinin__InfluenzaA__ADV69095
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaccaccgaaccccgagaauggaaccuguuauccuggcuacuuuacugacuaugaggaacugagagagcaacugucgucagucagcaguuucaagagguuugaaaucuucccaaaggaguccucuuggcccaaccauacagugaaugguguaagcuccucaugcagucacaacggggagagcucuuuuuaccggaaucucuuauggcugaccguuaaagauggacuuuauccuaacuuguccaagucauacacgaauaaaaaggaaaaagaggugcugguccuauggggcgugcaucacccaagcaacauuggcgaccagcgcgcucucuaccacacugaaaaugccuaugugagugucguuucuucccauuacagccgacguuucacccccgagaucgcaaagagaccuaaggugaggaaccaggaagggcggauaaacuauuacuggacacugcuugagccaggagauacuaucauuuuugaggccaaugguaaccugaucgcuccgcgcuaugcauucgaauugucgaaaggcuuugggucuggaauuaucaccuccaaugcccccaugggcgaguguaacgcuaagugccagacaccucaaggugccauaaauucaagucucccauuccagaacguacaccccgugaccauuggggaauguccuaaauacgucagaagcacgaagcugaggauggugacuggauuacggaauacaccauccauccagucucgcggccuguuuggcgcgauugcaggguucaucgagggagguuggaccggcaugguugacgggugguauggauaccaucaccagaacgaacaaggcagcgguuacgccgcugaucagcagucaacucagaaugccaucaacgggauuacaaauaaagugaacagugucauagagaagaugaauacccaauuuacggcagugggcaaagaguucaacaagcucgaacgaagaauggagaaucuuaacaagaaaaucgacgauggauuccuggacauuuggaccuauaacgcugaauugcuaguacugcucgagaaugaaaggacacuggauuuucacgacuccaacguuaagaaucuuuacgagaaagucaagagccagcugaaaaacaaugccaaggagaucggcaacgggugcuucgaauuuuaucauaaguguaaugacgagugcauggaaucugugaaaaacggaacuuacgauuaucccaaguacucagaggagaguaaauugaaucgggaaaagauagacggugugaaacucgagagcaugggcgucuauaacauucuggcgaucuacuccaccguggccucuucguuaguucugcuagugagccucggggcaaucuccuucuggaugugcucaaauggaagucugcagugucguauuugcaucuga

SEQ ID NO: 128371 - RNA, 1698 nt, Artificial Sequence
  derived and/or modified sequence opt3 from hemagglutinin__InfluenzaA__ADV69096
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacgucacagacuaugaggaacugagagagcaacugucgucagugagcaguuuuaagagguucgaaaucuuuccuaaggaguccucuuggccaaaccauaccguaacggguguuagcuccucaugcagucacaaugggaaaagcucuuucuaccggaaccucuuauggcugacugugaagaauggacuuuaucccaacuuguccaaaucauacaccaauaagaaagagaaggaaguccuggugcuauggggcgugcaucacccuagcaacauuggcgaucagcgcgcucucuaccacacagagaaugccuaugucaguguugugucuucccauuacagccgacguuuuacuccagaaaucgcaaagagacccaaaguaaggaaccaggaggggcggauaaacuauuacuggacccugcuugaaccuggagacacaaucauuuucgaggccaaugguaaccugaucgcuccacgcuaugcauuugaguugucgaagggcuucgggucuggaauuaucaccuccaaugccccgaugggcgaauguaacgcuaaaugccagacgcccaagggugccauaaauucaagucucccuuuucaaaacgugcacccagucacuauuggggagugucccaaauacguuaagagcgcgaaacugagaauggugacaggauuaaggaauaccccuuccauccagucucggggccuguucggcgcaauugccggguuuaucgaaggagguuggacuggcaugguggaugggugguauggauaccaucaccagaacgagcagggcagcgguuacgcugccgaccaacagucaacacagaaugcaaucaacgggauuaccaauaaggucaacagugugauagaaaagaugaauacgcaguucaccgcuguaggcaaagaguuuaacaagcucgagcgccgaauggaaaaucuuaacaaaaagguugaugacggauuccuggauaucuggacauauaacgccgaguugcuagugcugcucgaaaaugagagaacucuggacuuccacgaauccaacgucaaaaaucuuuacgagaaggucaagagccaacugaaaaacaaugcgaaggagauuggcaacgggugcuuugaguucuaucauaaauguaaugaugaaugcauggaaucugugaagaacggaaccuacgacuauccaaaauacucagaggagaguaaguugaauagggaaaagaucgacggugugaaacucgagagcaugggcguuuauaacauacuggccauuuacuccacaguggcaucuucguuaguacugcuagucagccucggggcuaucuccuuuuggaugugcucaaauggaagucugcagugucggaucugcauuuga

SEQ ID NO: 128372 - RNA, 1698 nt, Artificial Sequence
  derived and/or modified sequence opt3 from hemagglutinin__InfluenzaA__ADV69097
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaaaagagcugguccuacauuguggagaccccaaauccgggaaacggcgcuuguuaucccgguuacuuugccgacuaugaggaacugagagagcaacucucuucgguuagcucauucgaaagguuugagaucuucccuaaggaaaguuccuggucuaaucauaacgugaauggggucagcgcauccugcucacacaacggaaaaaguagcuuuuaccggaauuuacuguggcuuacuggcaagaacggcuuguauccaacacugaccaaaucuuacgccaaugauaaggagaaagaggugcuaauacucuggggaguacaucaccccuccaacaucggggaccagcgcacgcuguaccacacugaaaacgcuuauguuucagugaugagcagucauuacucucgacguuucaccccugagauuuccaagagaccaaaggucagggaucaggaaggucggaucaauuauuacuggacacuucuggagcccggcgacacuauuaucuuugaagcaaacgggaauuugauagccccuugguaugcuuucgcccucagccgcggauuuggcucggguauuaucaccucuaacgcgccaauggaugagugugacgcaaaaugccagacaccgcaaggggccauuaauuccucacugcccuuccagaacauccacccugugaccaucggagaguguccaaaguacgugagaagugcuaaauuaaggauggucacgggccugcggaauacucccagcauucagucccgcggccucuuuggggccauagcaggauucaucgaagguggcuggacagggaugguugauggaugguauggcuaccaucaccagaacgagcaagguucuggguacgcugccgaccaggaaagcacccagaaugcgauuaacgagaucacuaauaaggaaaacucagugauagagaaaaugaauacacaguuuaccaguguaggcaaggaguucaacaaacuugaacgaagaauggagaaucugaacaagaagguggaugacggauucuuggacauuuggacguauaacgccgaacuacugguccuccuggagaaugaaaggacccuugauuuucacgacuccaacgugaaaagccuguacgagaagguuaaaauccaauugaagaauaacgcaaaagagaucggcaaugggugcuucgaauuuuaucauaaguguaacaaugagugcauggaaucugugcggaacggaacauacgauuauccuaaguacucagaggagaguaaacucaaucgugaaaagauugacggugucaaacuggauagcaugggcguguaucagaucuuagcuauuuacuccacuguagccucuucgcugguucuacucgugagccugggggcuauauccuucuggaugugcucaaacggaagucuucagugucgcaucugcauuuga

SEQ ID NO: 128373 - RNA, 1698 nt, Artificial Sequence
  derived and/or modified sequence opt3 from hemagglutinin__InfluenzaA__ADV69098
augaaggugaaacugaucguccuccuuugcaccuucacagccacuuacgcugacacgauuuguguuggcuaucacgcaaacaauagcaccgauacaguggacacuguacuggagaagaacgugaccgucacacauuccgugaauuuguuagaagauucucacaacgggaaacugugccuacucaagggaauagcgccccugcagcuugguucauguaguguugccggcuggauccuggggaauccugagugcgaauugcucauuagcaaagaguccuggucuuacaucguggaaaccccaaacccggagaauggaacuuguuaucccggcuacuuuacagacuaugaggaacugagagagcaacugucgucagucagcaguuucaagagguuugaaauuuucccuaaggaguccucuuggccaaaccauaccgugacggguguaagcuccucaugcagucacaaugggaacagcucuuuuuaccggaaucucuuauggcugacuguuaaaaacggacuuuaucccaauuuguccaagucauacaccaacaaaaaggagaaagaagugcugguccuauggggcgugcaucacccuagcaauaucgaggaucagcgcgcucucuaccacacagaaaacgccuaugugagugucguuucuucccauuacagccgacguuucaacccagagauagcaaagagacccaaggugaggaaucaggaaggccggaucaacuauuacuggacucugcuugagccuggggacaccauuaucuuugaggccaauggaaaccugauugcuccacgcuaugcauucgaauugucgaaagguuuuggcucugggaucauaacauccaaugccccgaugggagaguguaacgcuaagugccagacgccccaaggcgccauuaauucaaaccucccuuuccagaauguacacccagugaccaucggugaaugucccaaauacgucagaagugcgaagcugaggauggugacuggguuacggaacacaccuagcauucagucccgcggacuguuuggcgcaaucgccggcuucaucgaagggggauggaccgguaugguugauggcugguauggguaccaucaccacaaugagcagggaucuggcuacgcugccaaccagaaaagcacuccaaaugcaauuaacgguauaacaaauaaggugaacucagucaucgagaaaaugaacacccaauuuacggcuguggggaaggaguucaauaagcucgaacgaagaauggagaaccuuaauaaaaagguagacgauggcuuccuggacauuuggaccuauaacgccgaauugcuaguucugcucgagaaugaaaggacacuggauuuucaugacaguaacgugaaaaaucuuuacgagaagguccggucccagcugaaaaacaaugcgaaggagaucggaaacggcugcuucgaauuuuaucacaaguguaaugaugagugcauggaaagcgugaaaaacgggacuuacgacuaucccaaguacucugaggagucaaaauugaaucgugaaaagauagacggagucaaacucgagaguauggguguguauaacauucuggccaucuacagcaccguugcauccucuuuagugcugcuaguaucgcucggcgcuaucagcuucuggaugugcuccaaugggucacugcagugucgcauuugcaucuga

SEQ ID NO: 128374 - RNA, 1698 nt, Artificial Sequence
  derived and/or modified sequence opt3 from hemagglutinin__InfluenzaA__ADV69099
augaaggugaaacugaucguccuccuuugcaccuucacagccacuuacgcugacacgauuuguguuggcuaucacgcaaacaauagcaccgauacaguggacacuguacuggagaagaacgugaccgucacacauuccgugaauuuguuagaagauucucacaacgggaaacugugccuacucaagggaauagcgccccugcagcuugguucauguaguguugccggcuggauccuggggaauccugagugcgaauugcucauuagcaaagaguccuggucuuacaucguggaaaccccaaacccggagaauggaacuuguuaucccggcuacuuuacagacuaugaggaacugagagagcaacugucgucagucagcaguuucaagagguuugaaauuuucccuaaggaguccucuuggccaaaccauaccgugacggguguaagcuccucaugcagucacaaugggaacagcucuuuuuaccggaaucucuuauggcugacuguuaaaaacggacuuuaucccaauuuguccaagucauacaccaacaaaaaggagaaagaagugcugguccuauggggcgugcaucacccuagcaauaucgaggaucagcgcgcucucuaccacacagaaaacgccuaugugagugucguuucuucccauuacagccgacguuucaacccagagauagcaaagagacccaaggugaggaaucaggaaggccggaucaacuauuacuggacucugcuugagccuggggacaccauuaucuuugaggccaauggaaaccugauugcuccacgcuaugcauucgaauugucgaaagguuuuggcucugggaucauaacauccaaugccccgaugggagaguguaacgcuaagugccagacgccccaaggcgccauuaauucaaaccucccuuuccagaauguacacccagugaccaucggugaaugucccaaauacgucagaagugcgaagcugaggauggugacuggguuacggaacacaccuagcauucagucccgcggacuguuuggcgcaaucgccggcuucaucgaagggggauggaccgguaugguuaauggcugguauggguaccaucaccacaacgaacagggaucuggcuacgcugccaaucaacagagcccacccaacgcaauuaaugguauaacuaacaaagugaacucagucaucgagaagaugaauacacaguuuaccgcuguggggaaagaguucaacaagcucgaacgaagaauggagaaucuuaacaagaaaguagaugacggcuuccuggauauuuggacguauaaugccgaauugcuaguucugcucgagaacgaaaggacccuggacuuucaugauaguaaugugaagaaccuuuacgagaaaguccggucccagcugaagaauaacgcgaaagagaucggaaauggcugcuucgaauuuuaucacaaguguaacgacgagugcauggaaagcgugaagaaugggacauacgauuauccgaaauacucugaggagucaaaguugaaccgugagaaaauagacggagucaagcucgagaguauggguguguauaauauucuggccaucuacagcacuguugcauccucuuuagugcugcuaguaucgcucggcgcuaucagcuucuggaugugcuccaacgggucacugcaaugucgcauuugcaucuga

SEQ ID NO: 128375 - RNA, 1698 nt, Artificial Sequence
  derived and/or modified sequence opt3 from hemagglutinin__InfluenzaA__ADV69100
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcaccccuucagcuggguaauuguucagucgcgggcuggauuuuggggaacccugagugcgaaagucucaucagcaaaaaguccuggucuuacauuguggagaccccaaagccggaaaauggaacuuguuaucccggcgaguuugcugacuacgaggaacugagagagcaacugucgucaguuagcaguuucgaaagguuugagaucuucccuaaagaguccucuuggccaaaccauacagccgccggugugagcgccuccugcucacacaauggggaacggaguuuuuauaagaaccucauaugguuaaccgucaaaaauggacuguaccccaaccuuagcaagucuuauaaaaaugauaaggagaaggaaguguugauccuguggggcguacaucacccuccaaacauugagaaucagcgcacgcuauaccacacugaaaacaccuacguuuccguggucucaagccauuauaguggccgauucacacccgagaucacuaaacguccuaaggugagagaccaggaggggaggauuaacuacuauuggacccuccuggaaccaggagauacaaucauauuugaggcuaaugguaaccuuauugcaccgugguacgccuucacccugucucggggcuugggguccggaaucgugacgagcaaugcucccauggacaaaugugaugccaagugccagacuccucacggcgcgauuaacucgucucucccauuucaaaauguccaucccguuacaaucggugaauguccuaaauaugugcgcuccgcaaagcugagaaugguaaccggguuaaggaacaucccaucaauucagagucggggacuguucggcgccauagcuggcuuuaucgaagggggauggacugguaugguggacggcugguacggguaucaccaccagaaugagcagggaagcggcuacgccgcagaucaagaguccacacagaacgcuauuaaugguaucaccaacaaagucaauucugugauagagaagaugaacacgcaguucaccgccguugggaaggaauuuaauaaacucgagcgccgaauggaaaaccuuaauaagaaaguggacgauggcuuccuggacauuuggacauacaacgcggaguugcuaguccugcucgaaaacgagagaacucuggacuuccaugauagcaaugugaagucacuuuaugagaaaguaaagagucagcugaagaacaaugccaaagaaaucggaaacggcugcuuugaguucuaccacaaguguaauaacgaaugcauggaguccguuaaaaaugggaccuaugacuaccccaaguauagcgaggaaucuaaauugaacagggagaagaucgauggagugaagcucgacucaaugggugucuaccggauucuggcaaucuauaguacaguggcuagcuccuuaguccugcuagugucucucggcgccauuucguuuuggaugugcagcaaugggucccugcaaugucguauaugcaucuga

SEQ ID NO: 128376 - RNA, 1698 nt, Artificial Sequence
  derived and/or modified sequence opt3 from hemagglutinin__InfluenzaA__ADV69101
augaaggugaaacugcucauccuuuucugcaccuuuacagccacuuacgcugacacgauuuguauaggcuaucacgcaaacaauagcaccgauacagucgacacuguucuggagaagaacgugaccguaacacauuccgugaauuuguuagaagauucucacaacgggaaacugugccuacucaagggaaucgcgccccugcagcuugguaauuguucagucgccggcuggauucuggggaacccugagugcgaaaguuugaucagcaaaaaguccuggucuuacauuguggagaccccaaauccggaaaacggagcuuguuaucccggcgaguucgccgacuacgaggaacucagagagcaacugucgucaguuagcaguuuugaaagguucgagaucuuuccuaaggaguccucuuggccaaaucauacugcaacaggugugagcgccuccugcucacacaacggggaacggaguuucuaucgcaaucugauauggcucaccgucaaaaacggauuauaccccaaucugagcaagucuuaugagaacgauaaagaaaaggaggugcuuaucuuguggggcguacaucacccuccaaauauugaaaaccagcgaacgcuguaccacacugagaacgcuuacguuuccguggucucaagccauuauaguggccguuuuacccccgagaucacaaaaagaccuaaggugagggaccaggaagggcggauuaauuacuauuggacucuacucgagccaggagauaccaucauauucgaagcaaacgguaaucugauugccccgugguacgcuuuuacacuuucucgcggccugggguccggaaucauuaccagcaacgcccccauggacgagugugauucgaagugccagacgccucaaggcgcgaucaauucuuccuugccauuccagaacgugcaccccgucacuaucggugaauguccuaaauauguuagaucagcaaagcucaggauggugacagggcugcggaauauuccaaguauacagagccgcggauuauuuggcgccaucgcuggcuucauugaagggggauggaccgguaugguagacggcugguacggguaucaucaccagaacgagcaaggauccggcuacgccgcagaucaggaaucuacucagaaugcuaucaacgguauaacaaauaaagugaacagcgucauugagaagaugaauccccaguuuaccgccguggggaaagaguucaacaagcuggagcgaagaauggaaaaucucaacaaaaagguugacgauggcuuccuugacaucuggacguacaacgcggagcuguuggugcuacuggagaaugaaaggacccucgacuuucacgauucaaacgucaagagucuguaugagaaagugaagucccaacuuaaaaauaacgccaaggaaaucggaaauggcugcuucgaguuuuaccauaaauguaacaaugagugcauggaaagcguaaagaacgggacauaugacuacccgaaguauucugaggaaucaaaacugaaucgggagaagauugauggaguuaaauuggacaguauggguguguaccguauccucgcaauuuauagcacugucgcuuccucucugguguuacuggucucgcuaggcgccaucagcuucuggaugugcuccaacgggucacuccagugucgcauaugcauuuga

SEQ ID NO: 128377 - RNA, 1698 nt, Artificial Sequence
  derived and/or modified sequence opt3 from hemagglutinin__InfluenzaA__ADV69102
augaaggugaaacugcucauccuuuucugcaccuuuacagccacuuacgcugacacgauuuguauaggcuaucacgcaaacaauagcaccgauacagucgacacuguucuggagaagaacgugaccguaacacauuccgugaauuuguuagaagauucucacaacgggaaacugugccuacucaagggaaucgcgccccugcagcuugguaauuguucagucgccggcuggauucuggggaacccugagugcgaaaguuugaucagcaaaaaguccuggucuuacauuguggagaccccaaauccggaaaacggagcuuguuaucccggcgaguucgccgacuacgaggaacucagagagcaacugucgucaguuagcaguuuugaaagguucgagaucuuuccuaaggaguccucuuggccaaaucauacugcaacaggugugagcgccuccugcucacacaacggggaacggaguuucuaucgcaaucugauauggcucaccgucaaaaacggauuauaccccaaucugagcaagucuuaugagaacgauaaagaaaaggaggugcuuaucuuguggggcguacaucacccuccaaauauugaaaaccagcgaacgcuguaccacacugagaacgcuuacguuuccguggucucaagccauuauaguggccguuuuacccccgagaucacaaaaagaccuaaggugagggaccaggaagggcggauuaauuacuauuggacucuacucgagccaggagauaccaucauauucgaagcaaacgguaaucugauugccccgugguacgcuuuuacacuuucuaccggccugggguccggaaucauuacgagcaacgcccccauggacgagugugauucgaagugccagacuccucaaggcgcgaucaauucuuccuugccauuccagaacgugcaccccgucacaaucggugaauguccuaaauauguucgcucagcaaagcucagaauggugaccgggcugaggaauauuccaaguauacagagccggggauuauuuggcgccaucgcuggcuucauugaagggggauggacugguaugguagacggcugguacggguaucaucaccagaacgagcaaggauccggcuacgccgcagaucaggaaucuacacagaaugcuaucaacgguauaaccaauaaagugaacagcgucauugagaagaugaauacgcaguuuaccgccguggggaaagaguucaacaagcuggagcgccgaauggaaaaucucaacaaaaagguugacgauggcuuccuugacaucuggacauacaacgcggagcuguuggugcuacuggagaaugaaagaacucucgacuuucacgauucaaacgucaagagucuguaugagaaagugaagucccaacuuaaaaauaacgccaaggaaaucggaaauggcugcuucgaguuuuaccauaaauguaacaaugagugcauggaaagcguaaagaacgggaccuaugacuaccccaaguauucugaggaaucaaaacugaauagggagaagauugauggaguuaaauuggacaguauggguguguaccggauccucgcaauuuauagcacagucgcuuccucucugguguuacuggucucgcuaggcgccaucagcuucuggaugugcuccaacgggucacuccagugucguauaugcauuuga

SEQ ID NO: 128378 - RNA, 1698 nt, Artificial Sequence
  derived and/or modified sequence opt3 from hemagglutinin__InfluenzaA__ADV69103
augaaggugaaacugaugguccuccuuugcaccuucacagccacuuacgcugacacgaucuguguuggcuaucacgcaaacaauagcaccgauacaguggacacuguacuggagaagaacgugaccgucacacauuccgugaauuuguuagaagauucucacaacgggaaacugugccuacucaagggaauugcgccccugcagcuugguucauguaguguugccggcuggauacuggggaauccugagugcgaauugcucaucagcaaagaguccuggucuuacauuguggaaaccccaaacccggagaauggaacuuguuaucccggcuacuuuacagacuaugaggaacugagagagcaacugucgucagucagcaguuucaagagguuugaaaucuucccuaaggaguccucuuggccaaaccauaaugugaccgguguaagcuccucaugcagucacaacgggaaaagcucuuuuuaccggaaucucuuauggcugacgguuaagaacggacuuuaucccaauuuguccaaaucauacacuaacaagaaagagaaggaagugcugguccuauggggcgugcaucacccuagcaauauuggcgaucagcgcgcucucuaccacaccgagaacgccuaugugagugucguuucuucccauuacagccgacguuucacaccagaaaucgcaaagagacccaaagugaggaaccaggaggggcggauaaauuauuacuggacucugcuugaaccuggagacaccaucauuuuugaggccaacgguaaucugaucgcuccacgcuaugcauucgaguugucgaagggcuuugggucuggaauuaucacauccaacgccccgauaggcgaauguaaugcuaaaugccagacgccccaaggugccauuaacucaagucucccuuuccagaauguaaacccagugaccaucggggagugucccaaguacgucaaaagcgcgaagcugagaauggugacuggauuaaggaauacaccuuccauucagucucggggccuguuuggcgcaaucgccggguucaucgaaggagguuggaccggcaugguugaugggugguauggauaccaccaucagaacgagcaaggcagcgguuacgcugccgaccagcagucaacucagaaugcaauuaacgggauaacaaauaaagugaacagugucaucgaaaagaugaauacccaauuuacggcugugggcaaggaguucaacaaacucgagcgccgaauggaaaaccuuaauaagaaaguagaugacggauuccuggauauuuggaccuauaacgccgaguugcuaguucugcucgaaaaugagagaacacuggacuuucacgauuccaacgugaagaaucuuuacgaaaaagucaagagccagcugaagaacaaugcgaaagagaucggcaacgggugcuucgaguuuuaucacaaguguaaugacgaaugcauggagucugugaaaaacggaacuuacgacuauccaaaguacucagaagagaguaaauugaauagggagaagauagauggugucaagcucgaaagcaugggcguguauaacauucuggccaucuacuccaccguugcaucuucguuagugcugcuaguaagccucggggcuaucuccuucuggaugugcucaaauggaagucugcagugucggauuugcaucuga

SEQ ID NO: 128379 - RNA, 1698 nt, Artificial Sequence
  derived and/or modified sequence opt3 from hemagglutinin__InfluenzaA__ADV69104
augaaggugaaacugcucauccuuuucugcaccuuuacagccacuuacgcugacacgauuuguauaggcuaucacgcaaacaauagcaccgauacagucgacacuguucuggagaagaacgugaccguaacacauuccgugaauuuguuagaagauucucacaacgggaaacugugccuacucaagggaaucgcgccccugcagcuugguaauuguucagucgccggcuggauucuggggaacccugagugcgaaaguuugaucagcaaaaaguccuggucuuacauuguggagaccccaaauccggaaaacggagcuuguuaucccggcgaguucgccgacuacgaggaacucagagagcaacugucgucaguuagcaguuuugaaagguucgagaucuuuccuaaggaguccucuuggccaaaucauacugcaacaggugugagcgccuccugcucacacaacggggaacggaguuucuaucgcaaucugauauggcucaccgucaaaaacggauuauaccccaaucugagcaagucuuaugagaacgauaaagaaaaggaggugcuuaucuuguggggcguacaucacccuccaaauauugaaaaccagcgaacgcuguaccacacugagaacgcuuacguuuccguggucucaagccauuauaguggccguuuuacccccgagaucacaaaaagaccuaaggugagggaccaggaagggcggauuaauuacuauuggacucuacucgagccaggagauaccaucauauucgaagcaaacgguaaucugauugccccgugguacgcuuuuacacuuucucgcggccugggguccggaaucauuaccagcaacgcccccauggacgagugugauucgaagugccagacgccucaaggcgcgaucaauucuuccuugccauuccagaacgugcaccccgucacuaucggugaauguccuaaauauguuagaucagcaaagcucaggauggugacagggcugcggaauauuccaaguauacagagccgcggauuauuuggcgccaucgcuggcuucauugaagggggauggaccgguaugguagacggcugguacggguaucaucaccagaacgagcaaggauccggcuacgccgcagaucaggaaucuacucagaaugcuaucaacgguauaacaaauaaagugaacagcgucauugagaagaugaauacccaguuuacggccguggggaaagaguucaacaagcuggagcgaagaauggaaaaucucaacaaaaagguugacgauggcuuccuugacaucuggaccuacaacgcggagcuguuggugcuacuggagaaugaaaggacacucgacuuucacgauucaaacgucaagagucuguaugagaaagugaagucccaacuuaaaaauaacgccaaggaaaucggaaauggcugcuucgaguuuuaccauaaauguaacaaugagugcauggaaagcguaaagaacgggacuuaugacuaccccaaguauucugaggaaucaaaacugaaucgggagaagauugauggaguuaaauuggacaguauggguguguaccguauccucgcaauuuauagcaccgucgcuuccucucugguguuacuggucucgcuaggcgccaucagcuucuggaugugcuccaacgggucacuccagugucgcauaugcauuuga

SEQ ID NO: 128380 - RNA, 1698 nt, Artificial Sequence
  derived and/or modified sequence opt3 from hemagglutinin__InfluenzaA__ADV69105
augaaggugaaacugcucauccuucugugcaccuucacagccacuuacgcugacacgauuuguauaggcuaucacgcaaacaauagcaccgauacagucgacacuguuuuggaaaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaaagucucaucagcaaaaaguccuggucuuacauuguggagaccccaaauccggaaaacggagcuuguuaucccggcgaguuugccgacuacgaggaacugagagagcaacugucgucaguuagcaguuucgaaagguuugagaucuucccuaaggaguccucuuggccaaaucauacugcagccggugugagcgcuuccugcucacacaacggggaacggaguuuuuaucgcaaucucauaugguuaacagucaaaaacggacuguaccccaaucuuagcaagucuuauaaaaacgauaaggagaaagaaguguugaucauuuggggcguacaucacccuccaaauaucgagaaccagcgaacccuguaccacacggaaaacgcauacguuuccguggucucaagccauuauaguggccguuucacucccgagauuaccaagagaccuaaggugagggaccaggaggggcggaucaauuacuauuggacacuacucgaaccaggagauacuauaauuuuugaggccaacgguaaucugaucgcuccgugguacgccuucacccuuucucgcggccugggguccggaauuaucacaagcaacgcgcccauggacgaaugugaugcaaaaugccagaccccucaaggcgccaucaauucgucuuugccauuucagaacgugcaccccgucacgauuggugaguguccuaaguauguuagauccgcuaaacucaggauggugacugggcugcggaauauaccaucaauccagagucgcggauuauucggcgccauugcaggcuuuaucgaagggggauggacagguaugguagacggcugguacggguaucaucaccagaacgagcaaggaagcggcuacgcugccgaucaggaguccacccagaaugcgauaaacgguauuacuaauaaggugaacucugucaucgagaaaaugaauacacaguucaccgccguggggaaggaauuuaacaaacuggaacgaagaauggagaaucucaacaagaagguugacgauggcuuccuugacaucuggacguacaacgcagaacuguuggugcuacuggagaaugagaggacccucgacuuccacgauagcaacgucaaaucacuguaugaaaaggugaaaagucaacuuaagaauaacgcuaaagagauuggaaauggcugcuuugaguucuaccauaaguguaacaaugaaugcauggaguccguaaagaacgggacauaugacuaccccaaauauagcgaagagucuaagcugaaucgggagaaaaucgauggaguuaaguuggacucaauggguguguaccguauucucgccauauauaguacugucgcuagcucccugguguuacuggucucucuaggcgccaucucguuuuggaugugcagcaacgggucccuccagugucgcauuugcaucuga

SEQ ID NO: 128381 - RNA, 1698 nt, Artificial Sequence
  derived and/or modified sequence opt3 from hemagglutinin__InfluenzaA__ADV69106
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaaagucucaucagcaaaaaguccuggucuuacauuguggagaccccaaauccgggaaacggcgcuuguuaucccgguuacuuugccgacuaugaagaacugagagagcaacugucgucaguuagcaguuucgaaagguuugagauguucccuaaggaauccucuuggccaaaucauaacgugaauggggucagcgcauccugcucacacaacggaaaaaguagcuuuuaccggaaucucuuauggcugacucgcaagaacggccuuuaucccaauuugacaaaaucuuacgccaacaacaaugauaaggaggugcugauccuauggggcguacaucacccuuccaacauaggggaccagcgaacccucuaccacacggagaaugcuuauguuucagugaugagcagucauuacucucguagauucacuccagaaaucaccaaaaggcccaagguccgggaucaggagggacgcauuaacuauuacuggacacugcuugaaccuggugacacuaucauuuuugaggcaaauggcaaccugaucgccccaugguaugcuuucgccuuguccaggagcuuugggucgggaauaauuaccucuuccgcgccgauggaugaaugugacgcaaagugccagacaccccaaggcgccaucaauucaagucucccuuuccagaacgugcacccagugaccauuggugagugucccaaauacgucagaagcgcuaagcugaaaaugguuacgggguuacggaauaucccuuccauccagucucgcggacuguuuggcgccauugcaggcuucauagaagggggauggacugguaugguggauggcugguauggguaccaucaccagaacgaacaaggaagcggcuacgcugccgaccaggagucaacacagaaugcgaucaacgguauuaccaauaagguaaacagugugaucgagaaaaugaauacucaguuuacagccgucgggaaggaguucaacaaacucgaaaagcgaauggagaaccuuaauaagaaaguggaugacggcuuccuggacauauggaccuauaacgcagaguugcuaguucugcucgaaaaugagagaacgcuggauuuucacgacuccaacgucaagagccuuuacgaaaaagugaagauucaacugaaaaauaacgcuaaggagaucggaaauggcugcuucgaauuuuaucauaaguguaacaaugagugcauggagucugugaggaacgggaccuacgauuauccaaaauacucagaagagaguaaguugaaucgggagaaaaucgacggaguaaagcucgauagcauggguguuuaucagauucuggccaucuacuccacaguggcuucuucguuaguccugcuagugagccucggcgccauuuccuucuggaugugcucaaacgggagucugcagugucguauaugcaucuga

SEQ ID NO: 128382 - RNA, 1698 nt, Artificial Sequence
  derived and/or modified sequence opt3 from hemagglutinin__InfluenzaA__ADV69107
augaaggugaaacugcucauccuucugugcaccuucacagccacuuacgcugacacgauuuguauaggcuaucacgcaaacaauagcaccgauacagucgacacuguuuuggaaaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaaagucucaucagcaaagaguccuggucuuacauuguggaaaccccaaauucggacaacggagcuuguuauccgggccaauuuacugauuacgaggagcugagagaacagcugucaagcguuaguuccuucgagagguuugaaaucuuccccaaggagucuagcuggccuaaucauacagugaccggugucuccgccucaugcagucacaacggggagcggagcuuuuaucgcaaucucauaugguuaacggugaagaacggacuguacccaaaucuuucuaaauccuaugaaaacgacaaggagaaagaaguauugauccuguggggcguucaucaucccccuaauauuggcgaucagcgaacucuauaccacaccgagaacgcauacaucucaguggucagcagucacuauucugggcguuucacaccagaaauuacuaagagacccaaagugagggaccaggagggacggaucaacuacuauuggacccuccuggagccuggugauacaauaauuuuugaagccaauggcaaccuuaucgcuccaugguacgcauucgcccugucccgcggguugggaagcggcauuaucaccucgaaugcuccgauggacaagugugaugccaagugccaaacgccccagggugcgaucaacucuucccucccuuuucagaaugugcacccagucacuauuggggagugucccaaauauguuagaucaacaaagcugaggauggugaccggauuacggaacauaccuaguauccagagccgcggccuguucggcgcaauugccggguuuaucgaaggagguuggacuggcaugguagacgggugguacggauaucaucaccaaaaugagcagggcuccgguuacgcugccgaucaggaaucuacacagaacgcaauaaaugggauuaccaacaaagugaauagcgucaucgagaagaugaacacgcaauucaccgcugugggcaaagaguuuaauaagcucgaacgaagaauggagaaccuuaauaaaaagguugacgacggauuccuggauaucuggacauacaacgccgaauugcuagugcugcucgagaacgaaaggacucuggacuuccacgauucaaaugucaagagucuuuaugagaaagugaagucccagcugaaaaacaaugcgaaggagauuggcaacgggugcuuugaguucuaccauaaauguaauaacgaaugcauggaaagcguacggaauggaaccuaugacuacccaaaguauucugaggagucaaaguugaaccgugagaaaaucgaugguguuaagcucgacaguaugggcguguaccgcauucuggccauauauagcacagcagcuuccucuuuaguccugcuagugucgcucggggccaucagcuuuuggaugugcuccaauggaucacugcaguguagaauuugcaucuga

SEQ ID NO: 128383 - RNA, 1698 nt, Artificial Sequence
  derived and/or modified sequence opt3 from hemagglutinin__InfluenzaA__ADV69108
augaaggugaaacugcucguccuucugugcaccuucacagccacuuacgcugacacgaucuguguuggcuaucacgcaaacaauagcaccgauacaguggacacuguauuggagaagaacgugaccgucacacauuccgugaauuuacuggaagauucucacaacgggaaacuaugccuccugaagggaauugcgccccuucagcuggguucauguaguguugccggcuggauauuggggaauccugagugcgaacuccugaucagcaaagaguccuggucuuacauuguggaaaccccaaacccggagaauggaacuuguuaucccggcuacuuuacagacuaugaggaacugagagagcaacucucgucagucagcaguuucaagagguuugaaaucuucccuaaggaguccucuuggccaaaccauaccgugacggguguaagcuccucaugcagucacaaugggaaaagcucuuuuuaccggaacuuacuguggcuuacuaugaagaauggauuguaucccaaccuguccaaaucauacaccaauaagaaagagaaggaaguucuagugcucuggggcguccaucacccuagcaacauuggcgaucagcgcgcucuguaccacacagagaaugccuaugugaguguggucucuucccauuacagccgacguuucacuccagaaaucgcaaagagacccaaaguuaggaaccaggaggggcggauaaacuauuacuggacccuucuggaaccugaggacacaaucauuuuugaggccaauggaaacuugaucgcuccacgcuaugcauucgaacucucgaaggguuuuggcucugggauuaucaccuccaaugccccgaugggagaguguaacgcuaaaugccagacgccccaaggcgccauaaauucaagucugccuuuccagaacgugcacccaguaacuauuggugaaugucccaaguacgugagaagcuccaaauuaaggauggucacagggcugcggaauaccccuucuauccagagccgcggacucuuuggcgcgauugcaggcuucaucgaagggggauggacugguaugguggauggcugguauggguaccaucaccagaacgaacaaggaucaggcuacgccgcugaccagcagaguacacagaaugccaucaacgguauuaccaauaagguuaacuccgugauagagaaaaugaauacgcaauuuaccgcagucgggaaggaguucaacaaacuugaacgaagaauggagaaucugaacaaaaagaucgaugacggcuucuuggauauuuggacauauaacgcugaacuacuggugcuccuggagaaugaaaggacucuugacuuucacgauagcaacguaaagaaucuguacgagaagguuaaaucucaguugaagaacaaugccaaggagaucggaaacggcugcuucgaauuuuaucauaaauguaaugacgagugcauggaaucagugaagaacgggaccuacgacuauccaaaauacagugaggagagcaagcucaaucgggagaaaauagauggagucaagcuggaguccauggguguguauaacauuuuagcgaucuacucuacagucgccucgagccuggugcuacucguuucccugggcgcaaucucauucuggaugugcaguaaugggucucuucagugucguauuugcaucuga

SEQ ID NO: 128384 - RNA, 1698 nt, Artificial Sequence
  derived and/or modified sequence opt3 from hemagglutinin__InfluenzaA__ADV69109
augaaggugaaacugcucauccuucugugcaccuucaaggccacauacgcugacacuauuuguauaggcuaucacgcaaacaauagcacggagaccgucgauacaguuuuggagaaaaacgugacuguaacccauuccgugaauuuacuggaggacucucacaacgggaagcuaugccuccugaaaggaaucgcgccccuucagcuggguaauuguucagucgccggcuggauuuuggggaacccugaaugcgagagucucaucagcaagaaguccuggucuuacauuguggaaacaccaaauccggagaacggagcuuguuaucccggcgaguuugccgauuacgaggaacugagagaacaacugucgucaguuagcaguuucgagagguuugagaucuucccuaaagaauccucuuggccaaaucauaccgcaacuggugugagcgccuccugcucacacaacggggagcggaguuuuuaucgcaaucucauaugguuaacagucaagaacggacuguaccccaaucuuagcaaaucuuaugaaaacgacaagaaaaaggagguguugauccuguggggcguacaucacccuccaaauauugaaaaccagcgaacccuauaccacacggagaacgcuuacguuuccguggucucaagccauuauaguggccguuucacucccgagaucaccaagagaccuaaagugagggaucaggaagggcggauuaauuacuauuggacacuccuggagccaggagacacuaucauauuugaagcaaacgguaaucuuauugccccgugguacgcuuucacccugucucgcggcuugggguccggaaucauuacaagcaacgcccccauggaugagugugacgcgaagugccagaccccuaaaggcgcaaucaauucgucucucccauuucaaaacgugcaccccgucacgaucggugaauguccuaaguauguuagauccgccaaacugaggauggugacuggguuacggaauauuccaucaauacagagucgcggacuguucggcgcuaucgccggcuuuauugaagggggauggacagguaugguagauggcugguacggguaucaucaccagaacgagcagggaagcggcuacgcagcugaccaagaauccacccagaaugccaucaacgguauaacuaauaaggugaacucugucauugagaaaaugaauacacaguucaccgcgguggggaaggaauuuaacaagcucgagcgaagaauggaaaaucuuaacaaaaagguugaugacggcuuccuggauaucuggacguacaacgccgaguugcuagugcugcucgagaaugaaaggacccuggacuuccacgacagcaacgucaaaucacuuuaugagaaggugaaaagucagcugaagaauaacgcaaaggaaaucggaaauggcugcuuugaguucuaccauaaauguaacaaugagugcauggaauccguaaagaacgggacauaugauuaccccaaauauagcgaggaaucuaaguugaaucgggagaaaauugacggaguuaagcucgauucaauggguguguaccguauccuggcuauuuauaguacugucgccagcuccuuagugcugcuagucucucucggcgcuauaucguuuuggaugugcagcaacgggucccugcaaugucgcaucugcauuuga

SEQ ID NO: 128385 - RNA, 1701 nt, Artificial Sequence
  derived and/or modified sequence opt3 from hemagglutinin__InfluenzaA__ADV76579
augaagaccaucauugcccugagcuacauacucugccuuguguucgcucagaaacugcccggcaacgacgauuccacagcaacuuuguguuuagggcaccaugccgucccuaauggaacgaucguuaagaccauuacaaacgaccaaaucgaggugacuaaugcgaccgaacugguacagucuucaaguacaggugagauuugcgauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuacguuuuaaguauccagcacugaacgugaccaugcccaauaacgagcaguucgauaaacuuuacauuuggggaguccaccauccuggcacagacaacgaucagaucuuuuuguaugcccaagcuagcggcagaauuacugugucuaccaagaggucccagcagacaguaaucccaaauauagggucacggccccgcguuagaaacauuccuagcaggaucaguauuuacuggaccaucgugaagccaggagacauccugcuaauuaauucuacggguaaccucauagccccgcggggcuacuucaaaauccgcuccggaaagagcucgauuaugcgaucugacgcgcccaucgggaaauguaauuccgaaugcauaacuccuaacggcucaauuccaaaugauaagcccuuucagaacgucaauagaaucacauauggugcauguccuagguacgugaagcaaaacacccugaaacuugccacugggaugcggaaugugccagagaagcagacacguggaaucuucggcgcuauugccggcuuuaucgaaaacgggugggagggaauggucgacgguugguauggcuuccgccaccagaauagugaggggagaggacaagcagcugaucugaaaagcacccaggccgcgauugaccagauaaacggcaaguugaauaggcucaucgguaaaacgaacgaaaaguuccaccagauugagaaagaauuuuccgagguugaagggcggauccaagaucuggagaaguacguggaggacaccaagaucgauuuauggucuuauaacgccgaacugcucguagcacuugagaaucagcauacaauugaccugacugauagcgaaaugaacaaauuguucgagaagaccaaaaagcagcuacgagaaaaugcugaggacaugggcaacggaugcuuuaaaauauaccacaagugugauaaugccugcaucggcucaauucgcaacgggacauaugaccaugacguguacagagaugaggcucugaauaacagguuccagaucaagggagucgaacucaaaagugguuacaaggacuggauucuguggaucuccuuugccauaagcugcuuccuucuguguguggcauugcucggcuuuaucaugugggccugccaaaaagggaauauucgguguaacaucugcauuuga

SEQ ID NO: 128386 - RNA, 1701 nt, Artificial Sequence; identical to SEQ ID NO: 125604
  derived and/or modified sequence opt3 from hemagglutinin__InfluenzaA__ADV76587

SEQ ID NO: 128387 - RNA, 1701 nt, Artificial Sequence; identical to SEQ ID NO: 125604
  derived and/or modified sequence opt3 from hemagglutinin__InfluenzaA__ADV76598

SEQ ID NO: 128388 - RNA, 1701 nt, Artificial Sequence; identical to SEQ ID NO: 125427
  derived and/or modified sequence opt3 from hemagglutinin__InfluenzaA__ADV76609

SEQ ID NO: 128389 - RNA, 1701 nt, Artificial Sequence; identical to SEQ ID NO: 125604
  derived and/or modified sequence opt3 from hemagglutinin__InfluenzaA__ADV76620

SEQ ID NO: 128390 - RNA, 1701 nt, Artificial Sequence
  derived and/or modified sequence opt3 from hemagglutinin__InfluenzaA__ADV76631
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccauggugaaaccaggagauauccugcuaaucaauucuacggguaaccucauugccccgaggggcuacuucaagauacgguccggaaagagcucgaucaugcgcucugacacucccauugggaaauguaauuccgagugcaucacaccuaacggcucaauaccaaaugacaagcccuuucagaacgucaaucgaauuaccuauggugcguguccuagauacgugaaacaaaacacucugaaacuugcaacagggaugaggaaugugccagaaaaacagacccggggaaucuucggcgccaucgcuggcuuuauugagaacgggugggaaggaauggucgaugguugguauggcuuccgucaccagaauagugaggggcgcggacaagccgcagaccuuaagagcacgcaggcugccaucgaucagauuaacggcaaauugaauagacucauagguaaggcgaacgagaaguuccaccagaucgaaaaagaguuuuccgaaguugaggggaggauucaagaccuggaaaaguacguggaggauaccaaaaucgacuuauggucuuauaacgccgagcugcucguagcacuugaaaaucagcauacaaucgaucugacugacagcgagaugaacaaguuguucgaaaagaccaagaagcagcuacgggagaaugcugaagauaugggcaacggaugcuuuaaaauuuaccacaagugugacaaugccugcauaggcucaauccgaaacgggacauaugaucaugacguguaccgcgacgaggcucugaauaacagauuccagauuaaaggagucgagcucaagagugguuacaaagauuggauccuguggauuuccuuugccaucagcugcuuccuucuguguguggcauugcucggcuuuauaaugugggccugccaaaaggggaauaucagguguaacauuugcaucuga

SEQ ID NO: 128391 - RNA, 1701 nt, Artificial Sequence; identical to SEQ ID NO: 127608
  derived and/or modified sequence opt3 from hemagglutinin__InfluenzaA__ADV76642

SEQ ID NO: 128392 - RNA, 1701 nt, Artificial Sequence; identical to SEQ ID NO: 127612
  derived and/or modified sequence opt3 from hemagglutinin__InfluenzaA__ADV76664

SEQ ID NO: 128393 - RNA, 1701 nt, Artificial Sequence
  derived and/or modified sequence opt3 from hemagglutinin__InfluenzaA__ADV76673
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacugagcaguagaauaucuauuuauuggaccaucgugaacccaggcgacgugcuagucauuaauuccaacgguaaucucaucgccccgaggggguacuuuaagaugcggacuggaaaaagcucgaucaugcgcucugacgcucccauugauacauguauauccgaaugcaucaccccuaacggcucaauuccaaaugacaagcccuuccagaacguuaauaaaaucacguacggcgccuguccuaaguaugugaaacagaacacccugaaacuugcgacagggaugcgaaauguaccagagaagcagacuagaggacuguuuggugcaaaagccggcuucauagaaaacgggugggagggaaugauugauggcugguacgguuuuaggcaccaaaauagugaggggaccggccaggcugccgaccuuaagagcacacaggcagcuaucgaucaaaucaacggaaaacucaaucgggugauugaaaagacuaacgagaaauuccaccagaucgaaaaggaguucuccgaagucgagggccguauucaggaccuggagaaauauguggaagauaccaagauagacuuauggucuuacaaugccgagcugcucguugcgcuugaaaaccagcauacaaucgaucugaccgacagcgagaugaacaaguuguuugaaaagacucgcagacaacuaagggagaaugccgaggauauggggaacggaugcuucaagauuuaucacaaaugugacaaugcaugcaucgaaucaauccggaacgguacguacgaccaugauguguaucgagacgaggcucugaauaaccgcuuucagauuaagggcgucgaacucaaaaguggguacaaggauuggauacuguggaucuccuucgccauuagcugcuuucuucugugugugguauugcucggauucaucaugugggcuugccagagaggcaauauuagguguaacaucugcauauga

SEQ ID NO: 128394 - RNA, 1701 nt, Artificial Sequence
  derived and/or modified sequence opt3 from hemagglutinin__InfluenzaA__ADV76682
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccggggaaagcucgauuaugcgcucugacgcacccaucggaaaauguaacuccgagugcauaacgccuaauggcucaauuccaaacgacaagcccuuucagaaugucaaccgaaucacuuauggugccuguccuagauacgugaagcaaaauacacugaaacuugcuaccgggaugaggaacgugccagaaaagcagacucggggaaucuucggcgccauugcaggcuuuaucgagaaugggugggagggaauggucgaugguugguauggcuuccgucaccagaacagugaagggcgcggacaagcugccgaccugaaaagcacacaggcggccauugaucagauaaauggcaaguugaacagacucaucgguaaaaccaacgagaaguuccaccagauugaaaaagaguuuuccgaaguugaggggaggauccaagaccuggagaaguacguggaagauacgaagaucgacuuauggucuuauaaugcagagcugcucguagcucuugaaaaccagcauaccauugaucugacagacagcgagaugaauaaauuguucgaaaagacuaaaaagcagcuacgggagaacgccgaggauaugggcaauggaugcuuuaaaauauaccacaagugugacaacgcuugcaucggcucaauucgaaaugggaccuaugaucaugacguguaccgcgacgaagcccugaacaauagauuccagaucaagggagucgagcucaaaagugguuacaaggauuggauucuguggaucuccuuugcaauaagcugcuuccuucuguguguggccuugcucggcuuuaucaugugggcuugccaaaaagggaacauuagguguaauaucugcauuuga

SEQ ID NO: 128395 - RNA, 1701 nt, Artificial Sequence; identical to SEQ ID NO: 125629
  derived and/or modified sequence opt3 from hemagglutinin__InfluenzaA__ADV76694

SEQ ID NO: 128396 - RNA, 1701 nt, Artificial Sequence; identical to SEQ ID NO: 125427
  derived and/or modified sequence opt3 from hemagglutinin__InfluenzaA__ADV76705

SEQ ID NO: 128397 - RNA, 1701 nt, Artificial Sequence; identical to SEQ ID NO: 125629
  derived and/or modified sequence opt3 from hemagglutinin__InfluenzaA__ADV76716

SEQ ID NO: 128398 - RNA, 1701 nt, Artificial Sequence
  derived and/or modified sequence opt3 from hemagglutinin__InfluenzaA__ADV76727
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggaagucuagcgcuugcauccggcgcuccaaaaacucauuuuucagucgacugaauuggcucacgcauuuaaacuuuaaguauccagcacugaaugugacuaugcccaacaacgagcaguucgacaaacuuuacauuuggggaguccaccauccuggcaccgauaaggaccagaucuuuuuguaugcccaagcuagcggccguauuacagugucuacuaaaagaucccagcagaccguaaucccaaauauagggucaaggccccggguucgcaacauuccuagcagaaucaguauuuacuggacaaucgugaagccaggagauauccugcuaauuaauucuaccgguaaccucauagccccgaggggcuacuucaagauccgguccgggaaaagcucgauuaugcgcucugacgcgcccaucggaaaguguaauuccgagugcauaacgccuaacggcucaauuccaaaugacaaacccuuucagaacgucaaucgaaucacuuauggugcauguccuagauacgugaagcaaaacacacugaaacuugccaccgggaugaggaaugugccagaaaagcagacucggggaaucuucggcgcuauugccggcuuuaucgagaacgggugggaaggaauggucgaugguugguauggcuuccgucaccagaauagugaggggcgcggacaagcagcugaccugaaaagcacacaggccgcgauugaucagauaaacggcaaguugaauagacucaucgguaagaccaacgagaaauuccaccagauugaaaaggaguuuuccgaaguugaggggaggauccaagaccuggaaaaauacguggaggauacgaagaucgacuuauggucuuauaacgccgagcugcucguagcacuugaaaaucagcauaccauugaucugacagacagcgagaugaacaaauuguucgaaaagacuaagaaacagcuacgggagaaugcugaagauaugggcaacggaugcuuuaagauauaccacaaaugugacaaugccugcaucggcucaauucgaaacgggaccuaugaucaugacguguaccgcgacgaggcucugaauaacagauuccagaucaagggagucgagcucaaaagugguuacaaggauuggauucuguggaucuccuuugccauaagcugcuuccuucuguguguggcauugcucggcuuuaucaugugggccugccaaaaggggaauauuagguguaacaucugcauuuga

SEQ ID NO: 128399 - RNA, 1701 nt, Artificial Sequence
  derived and/or modified sequence opt3 from hemagglutinin__InfluenzaA__ADV91009
augaaggccauccuggcugugcuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggaauagcaccccugcaucuugguaaaugcaacaucgccggcuggauucuggggaauccugagugugaaucuuugucaacagccaguagcugguccuacaucgucgagaccccaucuucggacaacggaacuugcuauccgggcgauuuuauugacuacgaggagcucagggagcagcugucaagcgugaguuccuucgaacgguuugagaucuuccccaagacaucuagcuggccuaaucacgauuccaacaaggguguuaccgcugcauguccacaugccggggcuaaaucauuuuauaagaaucugauauggcucgugaaaaagggaaacaguuaccccaaauuaagcaagucuuauaucaaugacaagggcaaaaagguccuggugcuuuggggcauucaccacccuuccacgucagccgaucaacagagcuuguaccagaacgcggacgcauacguauucguugggaccagucgcuauucuaaaaaguuuaaaccagaaaucgccauucgacccaaggugcgugaucaggagggaagaaugaauuacuauuggacucuggucgagccuggugacaaaaucacauucgaagcuacuggcaaccuaguggugccaagguacgccuuugcaauggagcggaacgcuggguccggaauaauuaucagcgauaccccgguccaugacugcaauacaaccugucaaacgcccaagggcgccauuaacacuucgcucccuuuccagaauauccacccaaucacaauugguaagugccccaaauauguugaaucuaccaagcugcgccuugcgacugggcugagaaacgugccuuccauacagucaaggggauuguuuggcgccaucgcaggcuucauugaagggggauggacagguaugguagacggcugguacggguaucaucaccagaaugaacaaggaaguggcuacgcugccgaucucaaaagcacccagaacgcuaucgacaagauaacgaauaaagugaacuccgucauugagaagaugaauacccaguuuacagccguggguaaggaguucaaccaccuggaaaaacggaucgagaauuuaaacaagaaaguugaugacggguuccuggauaucuggacuuacaaugcagaacuccuugugcuguuggagaacgaacgcacccuagacuaucaugauucuaaugucaagaaccuguacgagaaagugcgaagccagcucaagaacaaugccaaggagauuggcaacggauguuuugaguucuaucacaaaugcgacaauacauguauggaaucaguaaagaacggcacuuacgauuauccaaaauacagugaagaggcuaagcugaauagagaagagaucgacgggguuaaacuugaguccaccaggauuuaucaaauacuggcgaucuacagcacaguggcaucuucauugguccucguggucagucugggagccauuagcuuuuggaugugcuccaacgguucuuuacagugccggaucuguaucuga

SEQ ID NO: 128400 - RNA, 1701 nt, Artificial Sequence
  derived and/or modified sequence opt3 from hemagglutinin__InfluenzaA__ADV91010
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuacagacuacgaggagcucagggagcagcugagcaguguguccucuuucgaacgguuugagaucuucccgaagaccagcuccuggcccaaucacgauucaaacaagggugucacgacugccuguccucaugcuggggcaaaaaguuuuuauaagaaucugauuuggcucgugaaaaagggaaacagcuacccaaaauuaucuaaguccuauaucaaugacaagggcaaagaaguacugguucuuuggggcauacaccaucccccuaccucagccgaucaacagagcuuguaccagaacgcugacgccuacguguucgucgggacaagucgcuauucuaagaaauuuaagccagagaucgcgauucgacccaaagugcgugaucaggagggaagaaugaauuacuauuggacucugguggaaccuggugacaagaucaccuucgaggcaacaggcaaccuagucguuccaagguacgccuuugcuauggaacggaacgccggguccggaauuaucauaagcgauaccccggugcacgacugcaauacgacuugucaaacacccaaaggcgcaauuaacaccucgcucccuuuccagaauauccacccaauuacuaucgguaagugccccaaguauguaaaaucuacaaagcugcgccuugcuaccgggcugagaaacgugccuuccauccagucaaggggauuguuuggcgccauugcgggcuucauagaagggggauggacggguauggucgacggcugguacggguaucaucaccagaaugaacaaggaaguggcuacgccgcagaucucaaaagcacccagaacgcuaucgacgagauuacaaauaaggugaacuccguuaucgagaaaaugaauacucaguuuaccgccguggguaaggaguucaaccaccuggaaaagcggauagaaaauuuaaacaaaaaggucgaugacggguuccuggauauuuggacauacaaugcugagcuccuugugcuguuggaaaacgagcgcacucuagacuaucaugauucuaauguaaagaaccuguacgagaagguucgaagccagcucaaaaacaaugccaaggaaaucggcaacggauguuuugaguucuaucacaagugcgacaauaccuguauggaaucagugaaaaacggcacauacgauuauccaaaguacagugaggaagcaaaacugaauagagaggagaucgacggggucaaacuugaauccaccaggauuuaucaaauccuggccauuuacagcacuguggcuucuucauugguccucgugguuagucugggagcgaucagcuuuuggaugugcuccaacgguucuuuacagugccggauauguauuuga

SEQ ID NO: 128401 - RNA, 1701 nt, Artificial Sequence
  derived and/or modified sequence opt3 from hemagglutinin__InfluenzaA__ADW01407
auggaggccaagcuguucgugcucuuuugcgcuuucaccgcacuuaaagccgacacaaucugugucggcuaccacgcgaacaauagcacugauacgguugacaccauucuggaaaagaacgugacaguaacucauuccgugaauuuguuagagaacucucacaaugggaaacugugcucacuaaacggaaagauaccccuccagcuggguaauuguaacgucgcuggcuggauccuugggaauccuaaaugcgaucuguugcucaccgccaacaguuggagcuauauuaucgaaacauccaauucuaagaacggagcauguuacccaggcgaguuugccgacuaugaagaacugaaggagcaacugucgaccgugaguagcuucgaaagauuugagauuuucccgaaagcuacuucauggcccaaucaugauacaaccagggguacgacuguugcaugcucccacucuggggccaacagcuuuuaccggaaucucuuauggaucgugaagaaaggaaacuccuauccuaagcugucaaaaaguuacaccaacaauaagggcaaggaaguccuugugauauggggcguacaucacccacccacagacagcgaucagcagacuuuguaucagaacaaucacaccuacguuucugugggguccucaaaauacuauaagcgccugacaccugagaucgucgcucgaccaaaagugcgugagcaagccggaagaaugaacuacuauuggacccuacucgaccagggugauacgauuacuuucgaagcgacaggcaaucugaucgcacccuggcaugccuuugcucuuaagaaagggagcaguucuggaauuaugagguccgacgcccaggugcacaacuguaccacuaagugccagacaccucauggcgcacugaaagguaauuugccauuccaaaacguccacccgguuaccaucggggagugucccaaguacguaaagagcacgcagcuccggauggcuaccggacugcgcaauauaccuucgauucagucuagaggcuuauuuggcgccaucgcgggguucauugaaggagguuggacaggcaugguggaugggugguauggauaccaccauaggaacgagcagggcuccgguuaugccgcagaccaaaaaucaacucagaucgcuaucgaugggauuaguaauaaggugaacagcgucauagagaaaaugaauauccaguuuaccuccgugggcaaggaguucaacucucuggagaaacggauggaaaaucucaacaagaagguugacgacggauuccuugauguguggacauacaacgccgagcuguugauucuacuggaaaaugagcgcacucucgacuuucacgaucugaacgucaaaaaucuuuacgaaaaggugaaaagccaacugcgaaacaaugcuaaggagaucggcaacgggugcuucgaguuuuaucauaaaugugacaaugaaugcauggagucaguaaagaacggaaccuacaauuauccaaaguacagugaagaguccaaauugaacagagaagagauagaugguguuaagcucgagagcaugggcauucaccagauccuggccaucuauucuacaguggcaucaaguuuaguccugcuagugagccucggggccauuuccuucuggaugugcucuaauggaucgcugcaguguagggucugcaucuga

SEQ ID NO: 128402 - RNA, 1698 nt, Artificial Sequence; identical to SEQ ID NO: 125147
  derived and/or modified sequence opt3 from hemagglutinin__InfluenzaA__ADW09101

SEQ ID NO: 128403 - RNA, 1698 nt, Artificial Sequence
  derived and/or modified sequence opt3 from hemagglutinin__InfluenzaA__ADW09111
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccuagaggcgccauuaauucgucucugccauuccaaaacgugcaccccguaacaaucggugaguguccuaaguaugugagguccgcuaaauuacggauggucaccgggcugcgcaauauuccaucaauccagagucgaggacucuuuggcgccaucgcaggcuucauugaagggggauggacggguaugguggauggcugguacggguaucaucaccagaacgaccagggaagcggcuacgcugccgaucaaaaguccacucagaaugcgauaaacgguaucacaaauaaaguuaacucugugauugagaagaugaauacccaguuuacugccgucgggaaggaguucaacaaacuugaaagaaggauggagaaccugaauaagaaaguggacgauggcuucaucgacauauggacauacaacgcagaauugcuaguacugcucgagaaugaacggacccuggacuuucacgauagcaacguuaagaaucuuuaugagaaagugaagucacagcugaagaacaaugcuaaagaaauuggaaacggcugcuucgaguuuuaccauaaguguaaugacgagugcauggaaagugucaaaaacgggacguaugauuaccccaaguauuccgaggaaagcaaauugaaucgugagaagaucgacggagugaagcucgagucuaugggugucuaccaaauccuggccauuuauucaaccguggcuaguagcuuaguucugcuagugucccucggcgccaucucuuucuggaugugcucgaacgggagccugcagugucgcauuugcauauga

SEQ ID NO: 128404 - RNA, 1698 nt, Artificial Sequence
  derived and/or modified sequence opt3 from hemagglutinin__InfluenzaA__ADW09120
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaagucuuaugcaaauaacaaagagaaggaaguucuagugcucuggggcguccaccacccuccaaacaucguggaccagaaaacgcuguaccauacugagaaugccuacguguccgucguuucaagccacuauagucgcaaguucacccccgaaauagcuaagcgaccuaaagugcgugaucaggagggcagaaucaacuacuauuggacacuucuggagccaggggacacuauuaucuuugaagcaaauggaaacuugauugccccgagguacgcuuucgcccucucuaaggguuuuggcuccgggaucauaaauagcaacgcgcccauggauaaaugugacgcaaagugccagaccccucggggagccauuaauucgucucugccauuccaaaacguacaucccgugacaaucggcgaguguccuaaauauguccgcuccgcuaaguuaagaauggugaccggucugaggaauauuccaucaauccagagucgggggcucuuuggagccaucgcaggcuucauugaaggcggguggacgggaaugguugaugguugguacggcuaucaccaccagaacgagcaggggagcggauacgcugccgaccaaaaauccacucagaaugcgauaaacggcaucacaaauaaggugaacucugucauugaaaagaugaauacccaguuuacugccguggguaaagaguucaacaaacuugagcgccgaauggaaaaccugaauaaaaagguagaugacggguucaucgauauauggacauacaacgcagaguugcuaguucugcucgaaaaugagagaacccuggacuuucaugacagcaacgugaaaaaucuuuaugaaaaggucaagucacagcugaaaaacaaugcuaaggagauuggcaacggaugcuucgaguuuuaccacaaauguaaugaugaaugcauggagagugugaagaacggcacguaugacuaccccaaauauuccgaagagagcaaguugaauagggagaagaucgauggggucaaacucgaaucuaugggaguguaccaaauccuggccauuuauucaaccguugcuaguagcuuagugcugcuaguaucccucggugccaucucuuucuggaugugcucgaacggcagccugcagugucggauuugcauauga

SEQ ID NO: 128405 - RNA, 1698 nt, Artificial Sequence; identical to SEQ ID NO: 125632
  derived and/or modified sequence opt3 from hemagglutinin__InfluenzaA__ADW09131

SEQ ID NO: 128406 - RNA, 1698 nt, Artificial Sequence
  derived and/or modified sequence opt3 from hemagglutinin__InfluenzaA__ADW09153
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgugaaaaauggauuguaccccaaccugagcaagucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucacccccgaaauagcuaagcguccuaaagugagagaucaggagggcaggaucaacuacuauuggacacuucuggagccaggggacacuauuaucuuugaagcaaauggaaacuugauugccccgcgguacgcuuucgcccucucucgcgguuuuggcuccgggaucauaaauagcaacgcgcccauggauaagugugacgcaaaaugccagaccccuagaggagccauuaauucgucucugccauuccaaaacguacaccccgugacaaucggcgaguguccuaaguaugucagguccgcuaaauuacggauggugaccggucugcgcaauauuccaucaauccagagucgagggcucuuuggagccaucgcaggcuucauugaaggcggguggacgggaaugguugaugguugguacggcuaucaucaccagaacgagcaggggagcggauacgcugccgaccaaaaguccacucaggaugcgauaaauggcaucacaaacaaaguaaauucugucauugaaaagaugaacacccaguuuacugccguggguaaggaguucaauaaacuugagagaaggauggaaaaccugaacaagaaaguagacgauggguucaucgacauauggacauacaaugcagaguugcuaguucugcucgaaaacgagcggacccuggacuuucacgauagcaaugugaagaaccuuuaugaaaaagucaagucacagcugaagaauaacgcuaaagagauuggcaauggaugcuucgaguuuuaccauaaguguaacgacgaaugcauggagagugugaaaaauggcacguaugauuaccccaaguauuccgaagagagcaaauugaaccgugagaagaucgacggggucaagcucgaaucuaugggaguguaccaaauccuggccauuuauucaaccguugcuaguagcuuagugcugcuaguaucccucggugccaucucuuucuggaugugcucgaauggcagccugcagugucgcauuugcauauga

SEQ ID NO: 128407 - RNA, 1698 nt, Artificial Sequence; identical to SEQ ID NO: 125632
  derived and/or modified sequence opt3 from hemagglutinin__InfluenzaA__ADW09164

SEQ ID NO: 128408 - RNA, 1698 nt, Artificial Sequence
  derived and/or modified sequence opt3 from hemagglutinin__InfluenzaA__ADW09186
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauacgccaucaauucagagucgcggacucuuuggcgccaucgcaggcuucaucgaagggggauggacugguaugguggauggcugguacggguaucaucaccagaacgagcaaggaagcggcuacgcugccgaccagaaguccacacagaaugcgauuaacgguauaaccaauaaaguuaacucugugaucgaaaagaugaauacucaguuuacagccgucgggaaggaguucaacaaacuugagcgaagaauggaaaaccugaauaagaaaguggaugacggcuucauugauaucuggaccuacaacgcagaguugcuaguacugcucgaaaaugagaggacgcuggacuuucacgacagcaacguuaagaaucuuuaugaaaaagugaagucacaacugaagaacaaugcuaaagagauaggaaacggcugcuucgaguuuuaccauaaguguaaugaugaaugcauggagagugucaaaaacgggaccuaugacuaccccaaguauuccgaagagagcaaauugaaucgggagaagauugauggagugaagcucgaaucuaugggugucuaccagauccuggccaucuauucaacaguggcuaguagcuuaguucugcuagugucccucggcgccauuucuuucuggaugugcucgaacgggagccugcagugucguaucugcauuuga

SEQ ID NO: 128409 - RNA, 1698 nt, Artificial Sequence; identical to SEQ ID NO: 125147
  derived and/or modified sequence opt3 from hemagglutinin__InfluenzaA__ADW09197

SEQ ID NO: 128410 - RNA, 1698 nt, Artificial Sequence; identical to SEQ ID NO: 125632
  derived and/or modified sequence opt3 from hemagglutinin__InfluenzaA__ADW09208

SEQ ID NO: 128411 - RNA, 1698 nt, Artificial Sequence; identical to SEQ ID NO: 125632
  derived and/or modified sequence opt3 from hemagglutinin__InfluenzaA__ADW09219

SEQ ID NO: 128412 - RNA, 1698 nt, Artificial Sequence; identical to SEQ ID NO: 125147
  derived and/or modified sequence opt3 from hemagglutinin__InfluenzaA__ADW09230

SEQ ID NO: 128413 - RNA, 1698 nt, Artificial Sequence
  derived and/or modified sequence opt3 from hemagglutinin__InfluenzaA__ADW09241
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaaaugagagagcaacugucuucggugagcucauucgaaagguuugagauuuucccuaaggagaguuccuggccaaaccacacugucacaggugugucugccagcugcucccauaauggggaaucaaguuuuuaucggaaccucuuauggcugaccguuaaaaauggacuuuaccccaacuugagcaagucuuaugcaaauaacaaagagaaggaaguacuggugcuauggggcguccaccacccuccaaacaucguggaccagaaaacgcucuaccgcacugagaaugccuacguguccgucguuucaagccauuauagucgaaaguucacccccgaaauagcuaagcguccuaaagugagagaucaggagggcaggaucaacuacuauuggacacugcuugagccaggggacacuauuaucuuugaagcaaauggaaaccugauugccccgcgguacgcuuucgccuugucucgcgguuuuggcuccgggaucauaaauagcaacgcgcccauggauaagugugacgcaaaaugccagaccccuagaggagccauuaauucgucucucccauuccaaaacguacaccccgugacaaucggcgaguguccuaaguaugucagguccgcuaaacugcggauggugaccgguuuacgcaauauuccaucaauccagagucgagggcuguuuggagccaucgcaggcuucauugaaggcggguggacgggaaugguugaugguugguacggcuaucaucaccagaacgagcaggggagcggauacgcugccgaccaaaaguccacucagaaugcgauaaacggcaucacaaauaaagugaacucugucauugaaaagaugaauacccaguuuacugccguggguaaggaguucaacaaacucgagagaaggauggaaaaccuuaauaagaaaguagaugacggguucaucgauauauggacauacaacgcagagcuguugguucuacuggaaaaugagcggacccucgacuuucacgacagcaacgugaagaaucuguaugaaaaagucaagucacagcuuaagaacaaugcuaaagagauuggcaacggaugcuucgaguuuuaccauaaguguaaugaugaaugcauggagagugugaaaaacggcacguaugacuaccccaaguauuccgaagagagcaaacugaaucgugagaagaucgauggggucaaguuggaaucuaugggaguguaccaaauccucgccauuuauucaaccguugcuaguagccugguguuacugguaucccuaggugccaucucuuucuggaugugcucgaacggcagccuccagugucgcauuugcauauga

SEQ ID NO: 128414 - RNA, 1698 nt, Artificial Sequence; identical to SEQ ID NO: 125632
  derived and/or modified sequence opt3 from hemagglutinin__InfluenzaA__ADW09252

SEQ ID NO: 128415 - RNA, 1698 nt, Artificial Sequence
  derived and/or modified sequence opt3 from hemagglutinin__InfluenzaA__ADW09274
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaccuuaugcaaauaacaaagagaaggaaguucuagugcucuggggcguccaccacccacccaacaucguggaccagaaaacgcuguaccgcacugagaaugccuacgugucugucguuuccucacauuauagccgaaaguucaccccugaaauagcuaagcguccaaaagugagagaucaggagggcaggaucaacuacuauuggacacuucuggagccgggggacacuauuaucuuugaagcaaauggaaacuugauugcuccccgguacgccuucgcccucagucgcgguuuuggcucugggaucauaaauuccaacgcgccuauggauaagugugacgcaaaaugccagaccccaagaggagccauuaauagcucgcugcccuuccaaaacguacacccugugacaaucggcgaguguccaaaguaugucaggucugcuaaauuacggauggugaccggucugcgcaauauucccuccauccagucacgagggcucuuuggagccaucgcaggcuucauugaaggcggguggacgggaaugguugaugguugguacggcuaucaucaccagaacgagcaggggaguggauacgcugccgaccaaaagagcacucagaaugcgauaaacggcaucacaaauaaagugaacuccgucauugaaaagaugaauacccaguuuacugccguggguaaggaguucaacaaacuugagagaaggauggaaaaccugaauaagaaaguagaugacggguucaucgauauauggacauacaacgcagaguugcuaguucugcucgaaaaugagcggacccuggacuuucacgacucuaacgugaagaaucuuuaugaaaaagucaagagccagcugaagaacaaugcuaaagagauuggcaacggaugcuucgaguuuuaccauaaguguaaugaugaaugcauggagucagugaaaaacggcacguaugacuacccgaaguauagugaagaguccaaauugaaucgugagaagaucgauggggucaagcucgaaagcaugggaguguaccaaauccuggccauuuauucuaccguugcuucaaguuuagugcugcuaguaagccucggugccaucuccuucuggaugugcucuaacggcucgcugcagugucgcauuugcauauga

SEQ ID NO: 128416 - RNA, 1698 nt, Artificial Sequence
  derived and/or modified sequence opt3 from hemagglutinin__InfluenzaA__ADW09285
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaccuuugaagcaaaugguaacuugaucgccccgcgguacgcuuucgcccucucucgcggcuuuggguccggaauuaucaauagcaacgcgcccauggauaagugugacgcaaaaugccagacaccucaaggcgccauaaauucgucucugccauuccagaacgugcaccccguaaccauuggugaguguccuaaguaugugagauccgcuaaauuaaggauggucacggggcugcggaauaucccaucaauucagagucgcggacucuuuggcgccaucgcaggcuucaucgaagggggauggacugguaugguggauggcugguacggguaucaucaccagaacgagcaaggaagcggcuacgcugccgaccagaaguccacacagaaugcgauuaacgguauaaccaauaaaguuaacucugugaucgaaaagaugaauacucaguuuacagccgucgggaaggaguucaacaaacuugagcgaagaauggaaaaccugaauaagaaaguggaugacggcuucauugauaucuggaccuacaacgcagaguugcuaguacugcucgaaaaugagaggacgcuggacuuucacgacagcaacguuaagaaucuuuaugaaaaagugaagucacaacugaagaacaaugcuaaagagauaggaaacggcugcuucgaguuuuaccauaaguguaaugaugaaugcauggagagugucaaaaacgggaccuaugacuaccccaaguauuccgaagagagcaaauugaaucgggagaagauugauggagugaagcucgaaucuaugggugucuaccagauccuggccaucuauucaacaguggcuaguagcuuaguucugcuagugucccucggcgccauuucuuucuggaugugcucgaacgggagccugcagugucguaucugcauuuga

SEQ ID NO: 128417 - RNA, 1698 nt, Artificial Sequence; identical to SEQ ID NO: 125632
  derived and/or modified sequence opt3 from hemagglutinin__InfluenzaA__ADW09296

SEQ ID NO: 128418 - RNA, 1698 nt, Artificial Sequence; identical to SEQ ID NO: 125147
  derived and/or modified sequence opt3 from hemagglutinin__InfluenzaA__ADW09307

SEQ ID NO: 128419 - RNA, 1698 nt, Artificial Sequence
  derived and/or modified sequence opt3 from hemagglutinin__InfluenzaA__ADW09327
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucacgacagcaacguuaagaaucuuuaugaaaaagugaagucacaacugaagaacaaugcuaaagagauuggaaacggcugcuucgaguuuuaccauaaguguaauaacgaaugcauggagagugucaaaaaugggacguaugauuaccccaaguauuccgaagagagcaaauugaaccgggagaagaucgacggagugaagcucgaaucuaugggugucuaccagauccuggccauuuauucaaccguggcuaguagcuuaguucugcuagugucccucggcgccaucucuuucuggaugugcucgaaugggagccugcagugucguauuugcauauga

SEQ ID NO: 128420 - RNA, 1698 nt, Artificial Sequence; identical to SEQ ID NO: 125632
  derived and/or modified sequence opt3 from hemagglutinin__InfluenzaA__ADW10483

SEQ ID NO: 128421 - RNA, 1698 nt, Artificial Sequence
  derived and/or modified sequence opt3 from hemagglutinin__InfluenzaA__ADW10494
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucacgacagcaacguuaagaaucuuuaugaaaaagugaagaaccaacugaagaauaacgcuaaagagauuggaaauggcugcuucgaguuuuaccauaaguguaacgaugaaugcauggagucagucaaaaaugggacguaugacuaccccaaguauagugaagaguccaaauugaaccgggagaagaucgauggagugaagcucgaaagcaugggugucuaccagauccuggccauuuauucuaccguggcuucaaguuuaguucugcuagugagccucggcgccaucuccuucuggaugugcucuaaugggucgcugcagugucguauuugcauauga

SEQ ID NO: 128422 - RNA, 1698 nt, Artificial Sequence; identical to SEQ ID NO: 125632
  derived and/or modified sequence opt3 from hemagglutinin__InfluenzaA__ADW10505

SEQ ID NO: 128423 - RNA, 1698 nt, Artificial Sequence; identical to SEQ ID NO: 125632
  derived and/or modified sequence opt3 from hemagglutinin__InfluenzaA__ADW10516

SEQ ID NO: 128424 - RNA, 1698 nt, Artificial Sequence
  derived and/or modified sequence opt3 from hemagglutinin__InfluenzaA__ADW10527
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuugggcugggaaucauaaauuccaacgcgcccauggauaagugugacgcaaaaugccagaccccucaaggcgccauuaauagcucguuaccauuccagaacgugcaccccguaacaaucggugaguguccuaaguaugugagaucugcuaaacugaggauggucaccgggcuccggaauauuccauccauccagucacgcggacuuuuuggcgccaucgcaggcuucauugaagggggauggacggguaugguggauggcugguacggguaucaucaccagaacgagcaaggaaguggcuacgcugccgaccagaaaagcacucagaaugcgauaaacgguaucacaaauaaaguuaacuccgugauugaaaagaugaauacccaguuuacugccgucgggaaggaguucaacaaacuggagcgaagaauggaaaacuugaauaagaaaguggaugacggcuucaucgauauauggacauacaacgcagagcuacugguacuccuggaaaaugagaggacccuugacuuucacgacucuaacguuaagaaucuguaugaaaaaguaaagagccaauugaagaacaaugcuaaagagauuggaaacggcugcuucgaguuuuaccauaaguguaaugaugaaugcauggagucagucaaaaacgggacguaugacuaccccaaguauagugaagaguccaaacucaaucgggagaagaucgauggagugaagcuggaaagcaugggugucuaccagaucuuagccauuuauucuaccguggcuucaagucugguucuacucgugagccugggcgccaucuccuucuggaugugcucuaacgggucgcuucagugucguauuugcauauga

SEQ ID NO: 128425 - RNA, 1698 nt, Artificial Sequence
  derived and/or modified sequence opt3 from hemagglutinin__InfluenzaA__ADW10538
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccgugaugucaagccauuauagucgaaaguucacccccgaaauagcuaagcguccuaaagucagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacguucaccccgugacaaucggugaguguccuaaguauguaagauccgcuaaauuaaggauggugaccgggcugcggaauauuccaucaauccagagucgcggacucuuuggcgccaucgcaggcuucauugaagggggauggacggguauggucgauggcugguacggguaucaucaccagaacgagcaaggaagcggcuacgcugccgaccagaaguccacucagaaugcgauaaacgguaucacaaauaaagugaacucuguuauugaaaagaugaauacccaguuuacugccguggggaaggaguucaacaaacuugagcgaagaauggaaaaccugaauaagaaagucgaugacggcuucaucgauauauggacauacaacgcagaguugcuagugcugcucgaaaaugagaggacccuggacuuucacgacagcaacguaaagaaucuuuaugaaaaaguuaagucacaacugaagaacaaugcuaaagagauuggaaacggcugcuucgaguuuuaccauaaguguaaugaugaaugcauggagagugugaaaaacgggacguaugacuaccccaaguauuccgaagagagcaaauugaaucgggagaagaucgauggagucaagcucgaaucuauggguguguaccagauccuggccauuuauucaaccgucgcuaguagcuuagugcugcuaguuucccucggcgccaucucuuucuggaugugcucgaacgggagccugcagugucguauuugcauauga

SEQ ID NO: 128426 - RNA, 1698 nt, Artificial Sequence; identical to SEQ ID NO: 125632
  derived and/or modified sequence opt3 from hemagglutinin__InfluenzaA__ADW10549

SEQ ID NO: 128427 - RNA, 1698 nt, Artificial Sequence
  derived and/or modified sequence opt3 from hemagglutinin__InfluenzaA__ADW10560
augaaggugaaacugcucguccuucugugcaccuucacagccacuuacgcugacacgaucuguauuggcuaucacgcaaacaauagcaccgauacaguugacacuguguuugagaagaacguaaccgugacacauuccgucaauuuguuagaaaacucucacaaugggaaacugugccuacucaagggaauagcgccccugcagcuugguaacuguucaguggccggcuggauccuggggaauccugagugcgaauugcucauuaguaaagagagcugguccuacaucguugaaaagccaaacccggagaauggaaccuguuaucccggccauuucgcugauuacgaggaacugagagagcaacugucuucggugucauccuuugaaagguucgagauuuuuccuaaggagaguuccuggccaaaccacacugucacaggugugucugccagcugcucccauaauggggaacggucauucuaucgcaaccucuuauggcugaccggaaagaauggccuuuaccccaacuugaguaagagcuaugcaaauaacaaagagaaggaaguacugguucuauggggcgugcaccacccuccagacaucggggaucagaaaacgcucuaccauacugagaacgccuacgucucugugguguccucacacuauagccgaaaguuuacccccgaaauagcuaagcguccuaaagucagagaccaggagggaaggaucaauuacuauuggacacugcuugagccaggugauacuauuaucuucgaagcaaacggcaaucugauugccccgcgguacgcuuuugccuugagucgcggguucggaucuggcaucauaaacuccaaugcgcccauggacaagugugaugcaaaaugccagaccccucaaggugccauuaacagcucgcucccauuucagaauguucaucccgugacaaucggggaguguccuaaguauguaagaucugcuaaacugaggauggugaccggauuacggaacauuccauccauccagucacgcggccuguucggcgccaucgcaggguuuauugaaggagguuggacgggcauggucgacgggugguacggauaucaccaccagaaugagcaaggcagugguuacgcugccgaucagaaaagcacucagaacgcgauaaaugggaucacaaacaaagugaauagcguuauugaaaagaugaacacccaguucacugccgugggcaaggaguucaauaaacucgagcgaagaauggaaaaccuuaacaagaaagucgacgauggauuuaucgacauauggacauacaaugcagagcuguuggugcuacuggaaaacgagaggacccucgacuuccaugauucuaauguaaagaaccuguaugaaaaaguuaagagccaacuuaagaauaacgcuaaagagauuggcaaugggugcuuugaguucuaccacaaguguaacgacgaaugcauggagucagugaaaaauggaacguaugauuaccccaaguauagugaagaguccaaacugaaccgggagaagaucgacggugucaaguuggaaagcaugggcguguaccagauccucgccauuuauucuaccgucgcuucaagucugguguuacugguuagccuaggggccaucuccuuuuggaugugcucuaauggaucgcuccagugucguauuugcauauga

SEQ ID NO: 128428 - RNA, 1698 nt, Artificial Sequence; identical to SEQ ID NO: 127969
  derived and/or modified sequence opt3 from hemagglutinin__InfluenzaA__ADW10571

SEQ ID NO: 128429 - RNA, 1698 nt, Artificial Sequence; identical to SEQ ID NO: 125147
  derived and/or modified sequence opt3 from hemagglutinin__InfluenzaA__ADW10582

SEQ ID NO: 128430 - RNA, 1698 nt, Artificial Sequence; identical to SEQ ID NO: 125632
  derived and/or modified sequence opt3 from hemagglutinin__InfluenzaA__ADW10593

SEQ ID NO: 128431 - RNA, 1698 nt, Artificial Sequence; identical to SEQ ID NO: 125632
  derived and/or modified sequence opt3 from hemagglutinin__InfluenzaA__ADW10604

SEQ ID NO: 128432 - RNA, 1698 nt, Artificial Sequence; identical to SEQ ID NO: 125632
  derived and/or modified sequence opt3 from hemagglutinin__InfluenzaA__ADW10615

SEQ ID NO: 128433 - RNA, 1698 nt, Artificial Sequence
  derived and/or modified sequence opt3 from hemagglutinin__InfluenzaA__ADW10626
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccauccaucguggaccagaaaacgcuguaccgcacugagaacgccuacgugucagucguuagcagucauuauucucgaaaguucacccccgaaauagcuaagcguccuaaagugagagaucaggagggcaggaucaauuacuauuggacacuucuggagccaggggacacuauuaucuuugaagcaaacggaaauuugauugccccgcgguacgcuuucgcccucucccgcgguuuuggcagcgggaucauaaacucgaaugcgcccauggauaagugugacgcaaaaugccagaccccuagaggagccauuaacucuucccugccauuccaaaauguacaccccgugacaaucggcgaguguccuaaguaugucaggucagcuaaauuacggauggugaccggucugcgcaacauuccaaguauccagagccgagggcucuuuggagccaucgcaggcuucauugaaggcggguggacgggaaugguugaugguugguacggcuaucaucaccagaaugagcagggguccggauacgcugccgaccaaaagucuacucagaacgcgauaaauggcaucacaaacaaagugaauagcgucauugaaaagaugaacacccaguuuacugccguggguaaggaguucaauaaacuugagagaaggauggaaaaccugaacaagaaaguagaugacggguucaucgauauauggacauacaaugcagaguugcuaguucugcucgaaaacgagcggacccuggacuuucacgacucaaaugugaagaaccuuuaugaaaaagucaagagucagcugaagaauaacgcuaaagagauuggcaauggaugcuucgaguuuuaccauaaguguaacgaugaaugcauggaguccgugaaaaauggcacguaugacuaccccaaguauagcgaagagucuaaauugaaccgugagaagaucgauggggucaagcucgaaucaaugggaguguaccaaauccuggccauuuauaguaccguugcuagcuccuuagugcugcuaguaucucucggugccaucucguucuggaugugcagcaauggcucccugcagugucgcauuugcauauga

SEQ ID NO: 128434 - RNA, 1698 nt, Artificial Sequence
  derived and/or modified sequence opt3 from hemagglutinin__InfluenzaA__ADW10721
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugucaucuuucaagagguuugaaauuuucccuaaagagaguuccuggccaaaccacacugucacaggugugucugccagcugcucccauaauggggagucaaguuuuuaucggaacuuacuguggcuuaccguaaagaauggauuguaccccaaccugagcaaaucuuaugcaaauaacaaggaaaaagagguucuagugcucuggggcguccaccacccuccaaacaucguggaccagcgcacgcuguaccauacugaaaaugccuacguguccgucguuucaagccacuauagucgaaaguucacccccgagauagcuaagcguccuaaagugagaaaccaggaaggcaggaucaauuacuauuggacacuucuggagccaggggauacuauuaucuuugaggcaaacggaaauuugauugccccgcgguacgcuuucgcccucucucgcgguuuuggcuccgggaucauaaacagcaaugcgcccauggacaagugugaugcaaaaugccagaccccuagaggagccauuaacucgucucugccauuccaaaauguacaucccgugacaaucggcgaauguccuaaguaugucagguccgcuaaauuacggauggugaccggucugcgcaacauuccaucaauccagagucgagggcucuuuggagccaucgcaggcuucauugagggcggguggacgggaaugguugacgguugguacggcuaucaccaccagaaugaacaggggagcggauacgcugccgaucaaaaguccacucagaacgcgauaaauggcaucacaaacaaagugaauagcgucauugagaagaugaacacccaguuuacugccguggguaaggaguucaacaaacuugaaagaaggauggagaaucugaacaagaaaguagacgauggguucaucgacauauggacauacaaugcagaauugcuaguucugcucgagaacgaacggacccuggauuuucaugacagcaaugugaagaaccuuuaugagaaagucaagucacagcugaagaauaacgcuaaagaaauuggcaauggaugcuucgaguuuuaccacaaguguaacgacgagugcauggaaagugugaaaaauggcacguaugauuaccccaaguauuccgaggaaagcaaauugaaccgugagaagaucgacggggucaagcucgagucuaugggaguguaccaaauccuggccauuuauucaaccguugcuaguagcuuagugcugcuaguaucccucggugccaucucuuucuggaugugcucgaauggcagccugcagugucgcauuugcauauga

SEQ ID NO: 128435 - RNA, 1698 nt, Artificial Sequence
  derived and/or modified sequence opt3 from hemagglutinin__InfluenzaA__ADW10743
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaauaccuacguguccgucguuucaagccauuauagucgaaaguucacacccgaaauagccaagcguccuaaaaucagagaucaggagggcaggauuaacuacuauuggacucuucuggagccaggggacaccaucauuuuugaagcuaauggaaacuugaucgcaccgcgguacgccuucgcucucucucgcgguuuuggcuccgggauaauuaauagcaacgcccccauggauaagugugacgcgaaaugccagacaccuagaggagcaaucaauucgucucugccauuccaaaacgugcaccccguaaccauuggcgaguguccuaaguaugugagguccgucaaauuacggauggugacgggucugcgcaauaucccaucaauccagagucgagggcucuuuggagccauugcuggcuucauagaaggcggguggacuggaaugguugaugguugguacggcuaucaucaccagaacgagcaggggagcggauacgccgcagaccaaaaguccacacagaaugcuaucaacggcauuaccaauaaagugaacucugucaucgaaaagaugaauacucaguuuacagccguggguaaggaguucaacaaacuugagagaaggauggaaaaccugaauaagaaaguagaugacggguucauagauauuuggaccuacaacgcggaguugcuaguucugcucgaaaaugagcggacgcuggacuuucacgacagcaacgugaagaaucuuuaugaaaaagucaagucacagcugaagaacaaugccaaagagaucggcaacggaugcuucgaguuuuaccauaaguguaaugaugaaugcauggagagugugaaaaacggcaccuaugacuaccccaaguauuccgaagagagcaaauugaaucgugagaagaucgauggggucaagcucgaaucuaugggaguguaccaaauucuggcaaucuauucaacaguugcuaguagcuuagugcugcuaguaucccucggugccauuucuuucuggaugugcucgaacggcagccugcagugucgcauaugcaucuga

SEQ ID NO: 128436 - RNA, 1698 nt, Artificial Sequence
  derived and/or modified sequence opt3 from hemagglutinin__InfluenzaA__ADW10754
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccauggauaagugugacgccaaaugccagaccccucaaggcgcuauuaacagcucgcugccauuccagaauguucaucccgugacaaucggugaguguccuaaguauguacgcucugccaaauuaagaauggugaccgggcugaggaacauuccauccguccagucacggggacucuuuggcgcaaucgcuggcuucaucgaagggggauggacggguaugguggauggcugguacggguaucaccaccagaaugagcaaggaaguggcuacgccgcggaccagaaaagcacucagaacgccauuaaugguauaacaaacaaaguuaauuccgugaucgaaaagaugaacacccaguuuacugcagucgggaaggaguucaacaaacuugagcgccgaauggaaaaucugaacaagaaaguggaugacggcuucauugauaucuggacauacaaugcugaguugcuaguacugcucgaaaacgagagaacccuggacuuucaugacucuaauguuaagaaccuuuaugaaaaaguaaagagccaacugaagaauaacgccaaagagauaggaaauggcugcuucgaguuuuaccacaaguguaacgaugaaugcauggagucagucaaaaaugggacguaugacuaccccaaguauagugaagaguccaaauugaacagggagaagauugauggagugaagcucgaaagcaugggugucuaccagauccuggcuaucuauucuaccguggccucaaguuuaguucugcuagugagccucggcgcaauuuccuucuggaugugcucuaaugggucgcugcagugucggaucugcauuuga

SEQ ID NO: 128437 - RNA, 1698 nt, Artificial Sequence
  derived and/or modified sequence opt3 from hemagglutinin__InfluenzaA__ADW10765
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgugaaaaauggauuguaccccaaccugagcaagucuuaugcaaauaacaaagagaaggaaguucuagugcucuggggcguccaccacccuccaaacaucguggaccagaaaacgcuguaccauacugagaaugccuacguguccgucguuucaagccacuauagucgcaaguucacccccgaaauagcuaagcgaccuaaagugcguaaccaggagggcagaaucaauuacuauuggacacuucuggagccaggggauacuauuaucuuugaagcaaacggaaauuugauugccccgagguacgcuuucgcccucucucgggguuuuggcuccgggaucauaaacagcaaugcgcccauggacaagugugaugcaaaaugccagaccccucgcggagccauuaacucgucucugccauuccaaaauguacaucccgugacaaucggcgaguguccuaaguaugucagauccgcuaaauuaaggauggugaccggucugcggaacauuccaucaauccagagucgcgggcucuuuggagccaucgcaggcuucauugaaggcggguggacgggaaugguugacgguugguacggcuaucaccaccagaaugagcaggggagcggauacgcugccgaucaaaaguccacucagaacgcgauaaauggcaucacaaacaaaguaaauucugucauugaaaagaugaacacccaguuuacugccguggguaaggaguucaacaaacuugagcgaagaauggaaaaucugaacaagaaaguagacgauggguucaucgacauauggacauacaaugcagaguugcuaguucugcucgaaaacgagaggacccuggauuuucaugacagcaaugugaagaaccuuuaugaaaaagucaagucacagcugaagaauaacgcuaaagagauuggcaauggaugcuucgaguuuuaccacaaguguaacgacgaaugcauggagagugugaaaaauggcacguaugauuaccccaaguauuccgaagagagcaaauugaaccgggagaagaucgacggggucaagcucgaaucuaugggaguguaccaaauccuggccauuuauucaaccguugcuaguagcuuagugcugcuaguaucccucggugccaucucuuucuggaugugcucgaauggcagccugcagugucguauuugcauauga

SEQ ID NO: 128438 - RNA, 1698 nt, Artificial Sequence
  derived and/or modified sequence opt3 from hemagglutinin__InfluenzaA__ADW10776
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaaugacaaagagaaggaaguucuaguacucuggggcgugcaccacccuccaaacaucgucgaucagaaaacgcuguaccgcacugagaacgccuacguguccguggucucaagccauuauagucgaaaguucacccccgaaauagcuaagcguccuaaaguuagagaccaggaggggaggaucaauuacuauuggacacuucuggagccaggagauacuauuaucuuugaagcaaacgguaauuugauugccccgcgguacgcuuucgcccucucucgcggcuuuggguccggaaucauaaacagcaaugcgcccauggacaagugugaugcaaaaugccagaccccucaaggcgccauuaacucgucucugccauuccagaaugugcaccccguaacaaucggugaguguccuaaguaugugagauccgcuaaauuaaggauggucaccgggcugcggaacauuccaucaauccagagucgcggacucuuuggcgccaucgcaggcuucauugaagggggauggacggguaugguggacggcugguacggguaucaucaccagaaugagcaaggaagcggcuacgcugccgaucagaaguccacucagaacgcgauaaaugguaucacaaacaaaguuaauucugugauugaaaagaugaacacccaguuuacugccgucgggaaggaguucaauaaacuugagcgaagaauggaaaaccugaacaagaaaguggacgauggcuucaucgacauauggacauacaaugcagaguugcuaguacugcucgaaaacgagaggacccuggacuuucacgauagcaauguuaagaaccuuuaugaaaaagugaagucacaacugaagaauaacgcuaaagagauuggaaauggcugcuucgaguuuuaccauaaguguaacgacgaaugcauggagagugucaaaaaugggacguaugauuaccccaaguauuccgaagagagcaaauugaaccgggagaagaucgacggagugaagcucgaaucuaugggugucuaccagauccuggccauuuauucaaccguggcuaguagcuuaguucugcuagugucccucggcgccaucucuuucuggaugugcucgaaugggagccugcagugucguauuugcauauga

SEQ ID NO: 128439 - RNA, 1698 nt, Artificial Sequence
  derived and/or modified sequence opt3 from hemagglutinin__InfluenzaA__ADW10787
augaaggugaaaauccugguccuccuuugcaccuucacagccacuuacgcugacacgauuuguauaggcuaucacgcaaacaauagcaccgauacaguugacacugugcuggagaagaacguaaccgugacacauuccgucaauuuguuagaaaacucucacaaugggaaacugugccuacucaagggaaucgcgccccugcagcuugguaacuguucaguggccggcuggauucuggggaauccugagugcgaauugcucaucaguaaagagagcugguccuacauuguugaaaagccaaacccggagaauggaaccuguuaucccggccauuuugcugauuacgaggaacugagagagcaacugucuucggugagcucauucgaaagguuugagaucuucccuaaggagaguuccuggccaaaccacacugucacaggugugucugccagcugcucccauaauggggaaucaaguuuuuaucggaaccucuuauggcugaccguuaaaaauggacuuuaccccaacuugagcaagucuuaugcaaauaacaaagagaaggaaguacuggugcuauggggcguccaccacccuccaaacauaguggaccagaaaacgcucuaccgcacugagaaugccuacguguccgucguuucaagccauuauagucgaaaguucacccccgaaaucgcuaagcguccuaaagugagagaucaggagggcaggauuaacuacuauuggacacugcuugagccaggggacacuaucauuuuugaagcaaauggaaaccugaucgccccgcgguacgcuuucgccuugucucgcgguuuuggcuccgggauaauuaauagcaacgcgcccauggauaagugugacgcaaaaugccagaccccuagaggagccaucaauucgucucucccauuccaaaacguacaccccgugacaauuggcgaguguccuaaguaugucagguccgcuaaacugcggauggugaccgguuuacgcaauaucccaucaauccagagucgagggcuguuuggagccauugcaggcuucauagaaggcggguggacgggaaugguugaugguugguacggcuaucaucaccagaacgagcaggggagcggauacgcugccgaccaaaaguccacucagaaugcgaucaacggcauuacaaauaaagugaacucugucaucgaaaagaugaauacccaguuuacugccguggguaaggaguucaacaaacucgagagaaggauggaaaaccuuaauaagaaaguagaugacggguucauagauauuuggacauacaacgcagagcuguugguucuacuggaaaaugagcggacccucgacuuucacgacagcaacgugaagaaucuguaugaaaaagucaagucacagcuuaagaacaaugcuaaagagaucggcaacggaugcuucgaguuuuaccauaaguguaaugaugaaugcauggagagugugaaaaacggcacguaugacuaccccaaguauuccgaagagagcaaacugaaucgugagaagaucgauggggucaaguuggaaucuaugggaguguaccaaauucucgccaucuauucaaccguugcuaguagccugguguuacugguaucccuaggugccauuucuuucuggaugugcucgaacggcagccuccagugucgcauaugcaucuga

SEQ ID NO: 128440 - RNA, 1698 nt, Artificial Sequence
  derived and/or modified sequence opt3 from hemagglutinin__InfluenzaA__ADW10798
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccaugggcaagugugaugcaaaaugccagaccccucaaggugccauuaauucgucucugccauuccagaacgugcaccccguaacaaucggggaguguccuaaguaugugagauccgcuaaauuaaggauggucaccggacugcggaauauuccaucaauccagagucgcggccucuuuggcgccaucgcaggguucauugaaggagguuggacgggcaugguggacgggugguacggauaucaucaccagaacgagcaaggcagcgguuacgcugccgaucagaaguccacucagaaugcgauaaacgggaucacaaauaaaguuaacucugugauugaaaagaugaauacccaguuuacugccgucggcaaggaguucaacaaacuugagcgaagaguggaaaaccugaauaagaaaguagacgauggauucaucgacauauggacauacaacgcagaguugcuaguucugcucgaaaaugagaggacccuggauuuucacgacagcaacgugaagaaucuuuaugaaaaagucaagucacaacugaagaacaaugcuaaagagauuggcaacgggugcuucgaguuuuaccauaaguguaaugacgaaugcauggagagugugaaaaacggaacguaugauuaccccaaguauuccgaagagagcaaauugaaucgggagaagaucgacggugucaagcucgaaucuaugggcguguaccagauccuggccauuuauucaaccguugcuaguagcuuagugcugcuaguaucccucggggccaucucuuucuggaugugcucgaacggaagccugcagugucguauuugcauauga

SEQ ID NO: 128441 - RNA, 1698 nt, Artificial Sequence; identical to SEQ ID NO: 128437
  derived and/or modified sequence opt3 from hemagglutinin__InfluenzaA__ADW10809

SEQ ID NO: 128442 - RNA, 1698 nt, Artificial Sequence; identical to SEQ ID NO: 125632
  derived and/or modified sequence opt3 from hemagglutinin__InfluenzaA__ADW10820

SEQ ID NO: 128443 - RNA, 1698 nt, Artificial Sequence; identical to SEQ ID NO: 125147
  derived and/or modified sequence opt3 from hemagglutinin__InfluenzaA__ADW10831

SEQ ID NO: 128444 - RNA, 1698 nt, Artificial Sequence
  derived and/or modified sequence opt3 from hemagglutinin__InfluenzaA__ADW10842
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucgcucccgaaauagcaaagcguccuaaagugagagaucaggagggcaggaucaacuacuauuggacccuucuggagccaggggacacaauuaucuuugaagccaauggaaacuugauugcuccgcgguacgccuucgcgcucucucgcgguuuuggcuccgggaucauaaauagcaacgcacccauggauaagugugacgccaaaugccagacuccuagaggagcuauuaauucgucucugccauuccaaaacguacaccccgugaccaucggcgaguguccuaaguaugucagguccgccaaauuacggauggugacaggucugcgcaauauuccaucaauccagagucgagggcucuuuggagcaaucgcuggcuucauugaaggcggguggaccggaaugguugaugguugguacggcuaucaucaccagaacgagcaggggagcggauacgccgcggaccaaaaguccacgcagaaugccauaaacggcaucacuaauaaagugaacucugucauugaaaagaugaauacacaguuuaccgcaguggguaaggaguucaacaaacuugagagaaggauggaaaaccugaauaagaaaguagaugacggguucaucgauauauggacuuacaacgcugaguugcuaguucugcucgaaaaugagcggacacuggacuuucacgacagcaacgugaagaaucuuuaugaaaaagucaagucacagcugaagaacaaugccaaagagauuggcaacggaugcuucgaguuuuaccauaaguguaaugaugaaugcauggagagugugaaaaacggcaccuaugacuaccccaaguauuccgaagagagcaaauugaaucgugagaagaucgauggggucaagcucgaaucuaugggaguguaccaaauccuggcuauuuauucaacgguugccaguagcuuagugcugcuaguaucccucggugcaaucucuuucuggaugugcucgaacggcagccugcagugucgcauuugcauauga

SEQ ID NO: 128445 - RNA, 1698 nt, Artificial Sequence; identical to SEQ ID NO: 127988
  derived and/or modified sequence opt3 from hemagglutinin__InfluenzaA__ADW10853

SEQ ID NO: 128446 - RNA, 1698 nt, Artificial Sequence; identical to SEQ ID NO: 128437
  derived and/or modified sequence opt3 from hemagglutinin__InfluenzaA__ADW10864

SEQ ID NO: 128447 - RNA, 1698 nt, Artificial Sequence; identical to SEQ ID NO: 128437
  derived and/or modified sequence opt3 from hemagglutinin__InfluenzaA__ADW10875

SEQ ID NO: 128448 - RNA, 1698 nt, Artificial Sequence; identical to SEQ ID NO: 125632
  derived and/or modified sequence opt3 from hemagglutinin__InfluenzaA__ADW10886

SEQ ID NO: 128449 - RNA, 1698 nt, Artificial Sequence
  derived and/or modified sequence opt3 from hemagglutinin__InfluenzaA__ADW10897
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccauccaucucagaccagaaaacgcuguaccauacugagaacgccuacgucagcguggugaguucucacuauucccgcaaguucacccccgaaauagcuaagcgaccuaaaguccgugaucaggaggggagaaucaauuacuauuggacacuucuggagccaggagacacuauuaucuuugaagcaaacgguaauuugauugccccgagguacgcuuucgcccucagccggggcuuugggucgggaaucauaaacucuaaugcgcccauggauaagugugacaccaaaugccagacaccucaaggcgcaauuaacuccucacugccauuccagaauguucaucccgugaccaucggugaguguccuaaguauguacgcagugccaaauuaagaauggugacggggcugaggaacauuccaagcauccagucccggggacucuuuggcgcuaucgccggcuucauugaagggggauggacugguauggucgauggcugguacggguaucaccaccagaaugagcaaggaucuggcuacgcagcugaccagaaaagcacacagaacgccauaaaugguaucaccaacaaaguaaauucaguuauugaaaagaugaacacucaguuuacagcgguggggaaggaguucaauaaacuugagcgccgaauggaaaaccugaacaagaaagucgaugacggcuucaucgauauauggaccuacaaugccgaguugcuagugcugcucgaaaacgagagaacgcuggacuuucaugacaguaauguaaagaaccuuuaugaaaaaguuaagucccaacugaagaauaacgcaaaagaggugggaaauggcugcuucgaguuuuaccacaaguguaacgaugaaugcauggagagcgucaaaaaugggaccuaugacuaccccaaguauucugaagagucaaaauugaacagggagaagauugauggagugaagcucgaaaguaugggugucuaccagauccuggcuaucuauagcacaguggccuccucuuuaguucugcuagugucgcucggcgcuauuagcuucuggaugugcuccaaugggucacugcagugucggaucugcauuuga

SEQ ID NO: 128450 - RNA, 1701 nt, Artificial Sequence
  derived and/or modified sequence opt3 from hemagglutinin__InfluenzaA__ADW23115
augaagaccaucauugcccugagcuacauacucugccuuguguucgcucagaaacugcccggcaacggaaauuccacagcaacuuuguguuuagggcaccaugccgucccuaacgguacgaucguuaagaccauuacaaaugaccaaaucgaggugacuaacgcgaccgaacugguacagucuucaaguacaggcgagauuugcgauagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucaacuggacagggguuacccagaauggaacgucuagcgcuugcauccggcgcuccaacaauucauuuuucagucgacugaacuggcucacucauagcaaguuuaaguauccagcauuaaaugugaccaugcccaacaacgagcaguucgauaaacuguacauuuggggcguccaccauccuggcacagacaaugaucagaucuuucuuuaugcccaggcuucugggcguauuacuguguccaccaagagaucacaacagacaguaaucccaaacauaggaagcaggccccggguucgcaauauuccuaguagaaucucuauuuacuggaccaucgugaaaccaggugacaucuugcugauuaacuccacgggcaaucuaauagccccgaggggguacuucaagauccggagcggaaaaucgucuauuaugcgcuccgaugcgcccaucggcaaguguaacucagaaugcauaacuccuaaugguaguauuccaaacgacaagcccuuucagaaugucaaccgaaucacauauggggcauguccuagauacgugaaacaaaauacccucaagcuggccacuggaaugaggaacgugccagagaaacagacacggggcaucuucggcgcuauugccggguuuaucgaaaauggaugggaggguauggucgacggcugguauggguuccgucaccagaacagcgagggacgcggccaagcagcugaucuuaaguccacccaggccgcgauugaccagauaaaugguaaacugaacagauugaucgggaagacgaacgaaaaauuccaccagauugagaaggaauuuucugagguugaaggcaggauccaagaucucgagaaguacguggaggacaccaaaaucgaucuguggagcuauaaugccgaauuacugguagcacucgagaaccagcauacaauugaccuuacugauucagaaaugaauaagcuguucgagaaaaccaagaaacaguugcgggaaaacgcugaggacaugggaaauggcugcuuuaagauauaccacaagugugauaacgccugcaucgggaguauucgaaauggaacauaugaccaugauguguaccgcgacgaggcucuaaacaauagauuccagaucaaaggugucgaacugaaguccggcuacaaagacuggauucucuggaucagcuuugccauaucuugcuuccugcuuuguguggcacuguugggguuuaucaugugggccugccaaaagggaaacauuagguguaauaucugcauuuga

SEQ ID NO: 128451 - RNA, 1701 nt, Artificial Sequence
  derived and/or modified sequence opt3 from hemagglutinin__InfluenzaA__ADW54481
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaucggcaauggauguuuugaguucuaucacaaaugcgacaacaccuguauggaaagcgugaagaauggcacauacgauuauccuaaauacucagaagaggcaaagcugaacagagaagagauugacggggucaaacuugagaguaccaggaucuaucaaauucuggccauauacuccacuguggcuagcucuuugguccucgugguuucacugggagcgaucaguuuuuggaugugcagcaaugguuccuuacagugccggauuuguaucuga

SEQ ID NO: 128452 - RNA, 1701 nt, Artificial Sequence
  derived and/or modified sequence opt3 from hemagglutinin__InfluenzaA__ADW54512
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucaagcgguuugaaauuuucccgaagacaagcuccuggcccaaucacgauucaaacaaaggugucaccacggccuguccucaugcuggggcaaagaguuuuuauaaaaaucugaucuggcucgugaagaaaggaaacagcuacccaaaguuaucuaaguccuauauaaaugacaaaggcaaggagguacugguucuuuggggcauccaccaucccccuacuucagccgaucaacagagcuuguaccagaacgcugacgccuacguguucgucgggaccagucgcuauucuaaaaaguuuaaaccagaaauugcgauccgacccaaggugcgugaucaggagggaagaaugaauuacuauuggacacugguggagccuggugacaaaauuacuuucgaagcaaccggcaaccuagucguuccaagguacgccuuugcuauggagcggaacgccggguccggaaucauaauuagcgauacaccggugcacgacugcaauaccacgugucaaacucccaagggcgcaaucaacacaucgcucccuuuccagaauauucacccaaucaccaucgguaagugccccaaauauguaaagucuacuaaacugcgccuugcuacagggcugagaaacgugccuuccauucagucaaggggauuguuuggcgccauagcgggcuucaucgaagggggauggaccgguauggucgacggcugguacggguaucaucaccagaaugagcaaggaaguggcuacgccgcagaucucaagagcacgcagaacgcuauugacgaaaucaccaauaaagugaacuccguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauucuaauguaaagaaccuguacgagaaaguucgaagccagcucaagaacaaugccaaggagaucggcaacggauguuuugaguucuaucacaaaugcgacaauacuuguauggagucagugaagaacggcaccuacgauuauccaaaauacagugaagaggcaaagcugaauagagaagagauugacggggucaaacuugaguccacaaggaucuaucaaauucuggccauauacagcaccguggcuucuucauugguccucgugguuagucugggagcgaucagcuuuuggaugugcuccaacgguucuuuacagugccggauuuguaucuga

SEQ ID NO: 128453 - RNA, 1701 nt, Artificial Sequence
  derived and/or modified sequence opt3 from hemagglutinin__InfluenzaA__ADW54527
augaaggccauccuggugguccuccuuuacaccuucgcuacagcaagcgccgacacucugugcauuggcuaucacgcgaacaauuccacggauaccguugacacaguguuggagaaaaacguaacugugacccauucugucaauuuacuggaagauaagcacaacgggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaacuugcuauccaggcgauuuuaucgacuacgaggagcucagggagcagcugaguuccgugucuagcuucgaacgguuugagauuuucccgaagacauccucauggcccaaccacgauaguaauaagggugucaccacggccuguccucaugcuggggcaaagagcuuuuauaaaaaccugaucuggcucgugaaaaagggaaauucuuacccaaaauuauccaagucauauauaaacgacaagggcaaagaaguacugguucuuuggggcauccaccaucccccuacuagcgccgaucaacagaguuuguaccagaaugcugacgccuacguguucgucgggaccucucgcuauuccaagaaauuuaagccagagauugcgauccgacccaaagugcgugaucaggagggaagaaugaacuacuauuggacacugguggaaccuggugacaagauuacuuucgaggcaaccggcaaucuagucguuccaagguacgccuuugcuauggaacggaacgccgggagcggaaucauaauuucggauacaccggugcacgacugcaacaccacgugucaaacucccaauggcgcaaucaacacaucucucccuuuccagaauauucacccaaucaccaucgguaaaugccccaaguauguaaaguccacuaaacugcgccuugcuacagggcugagaaacgugccuucaauucagaguaggggauuguuuggcgccauagcgggcuucaucgaagggggauggaccgguauggucgacggcugguacggguaucaucaccagaaugaacaaggaagcggcuacgccgcagaucucaaguccacgcagaacgcuauugacgagaucaccaauaaagugaacucuguuauagagaagaugaauacacaguuuacugccguggguaaagaguucaaccaccuggaaaagcggauugaaaauuuaaacaagaaagucgaugacggguuccuggauaucuggaccuacaaugcugagcuccuugugcuguuggaaaacgagcgcacacuagacuaucaugauagcaauguaaagaaccuguacgagaaaguucgaucacagcucaagaacaaugccaaagaaaucggcaacggauguuuugaguucuaucacaagugcgacaauacuuguauggaaagugugaagaacggcaccuacgauuauccaaaauacuccgaggaagcaaagcugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 128454 - RNA, 1701 nt, Artificial Sequence; identical to SEQ ID NO: 128451
  derived and/or modified sequence opt3 from hemagglutinin__InfluenzaA__ADW65825

SEQ ID NO: 128455 - RNA, 1701 nt, Artificial Sequence
  derived and/or modified sequence opt3 from hemagglutinin__InfluenzaA__ADW82135
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacaggugagaucugcgacagcccacaccagauucuagauggcaaaaauuguacccucaucgacgcucugcuuggggauccgcagugcgacggauuucaaaacaagaaaugggaucuguucgucgaaagauccaaggccuauucuaauuguuaccccuaugacgugccugauuacgcaucguugaggucacucguugccagcaguggcacucuggaguuuaacaaugaauccuucaacuggacaggugugacccagaaugggacgucuagcgcuugcauacggcgcuccaagaacucauuuuucagucgacugaauuggcucacucauuuaaacuuuaaauauaccgcacugaaugucacaaugccaaacaacgagcaguucgacaagcuguacaucuggggagugcaccaucccggcacugauaaagaccagauuuuucuuuaugcccaagcuagcggccguaucaccguaucuacaaagagaucccagcagaccguuauuccuaauaucgggucaaggccacgggugcgcaacauacccagcagaauuaguaucuacuggacgauugucaaaccuggagauauccugcuaaucaauucuacugguaaccucauugccccaaggggcuacuucaagauacgguccgggaaaagcucgaucaugcgcucugacgcgccgauuggaaaauguaauuccgagugcaucacacccaacggcucaauaccuaaugacaagccauuucagaacgugaaucgaauuaccuauggugcaugucccagauacgugaaacaaaacacucugaaguuggccacagggaugaggaaugucccugaaaaacagacccggggaaucuucggcgcuaucgccggcuuuauugagaacgggugggaaggaaugguugaugguugguauggcuuccgucaccagaauagugaggggcgcggacaagcagcugaccuuaagagcacgcaggccgcgaucgaucagauuaacggcaaauugaauagacucauagguaagaccaacgagaaguuccaccagaucgaaaaagaguuuuccgaaguggaggggaggauucaagaccuggaaaaguacguagaggauacaaaaaucgacuuauggucuuauaacgccgagcugcucguggcacuugaaaaucagcauacuaucgaucugaccgacagcgagaugaacaaguuguucgaaaagacaaagaagcagcuacgggagaaugcugaagauaugggcaacggaugcuuuaaaauuuaccacaagugugacaaugccugcauaggcucaauccgaaacgggacuuaugaucaugacgucuaccgcgacgaggcucugaauaacagauuccagauuaaaggaguggagcucaagagugguuacaaagauuggauccuguggauuuccuuugccaucagcugcuuccuucuguguguugcauugcucggcuuuauaaugugggccugccaaaaggggaauaucagguguaacauuugcaucuga

SEQ ID NO: 128456 - RNA, 1701 nt, Artificial Sequence; identical to SEQ ID NO: 128455
  derived and/or modified sequence opt3 from hemagglutinin__InfluenzaA__ADW82155

SEQ ID NO: 128457 - RNA, 1701 nt, Artificial Sequence; identical to SEQ ID NO: 128455
  derived and/or modified sequence opt3 from hemagglutinin__InfluenzaA__ADW82166

SEQ ID NO: 128458 - RNA, 1701 nt, Artificial Sequence; identical to SEQ ID NO: 128455
  derived and/or modified sequence opt3 from hemagglutinin__InfluenzaA__ADW82177

SEQ ID NO: 128459 - RNA, 1701 nt, Artificial Sequence; identical to SEQ ID NO: 124685
  derived and/or modified sequence opt3 from hemagglutinin__InfluenzaA__ADW82188

SEQ ID NO: 128460 - RNA, 1701 nt, Artificial Sequence; identical to SEQ ID NO: 124685
  derived and/or modified sequence opt3 from hemagglutinin__InfluenzaA__ADW82198

SEQ ID NO: 128461 - RNA, 1701 nt, Artificial Sequence; identical to SEQ ID NO: 124685
  derived and/or modified sequence opt3 from hemagglutinin__InfluenzaA__ADW82208

SEQ ID NO: 128462 - RNA, 1701 nt, Artificial Sequence; identical to SEQ ID NO: 124685
  derived and/or modified sequence opt3 from hemagglutinin__InfluenzaA__ADW82218

SEQ ID NO: 128463 - RNA, 1701 nt, Artificial Sequence; identical to SEQ ID NO: 124685
  derived and/or modified sequence opt3 from hemagglutinin__InfluenzaA__ADW82228

SEQ ID NO: 128464 - RNA, 1701 nt, Artificial Sequence; identical to SEQ ID NO: 124685
  derived and/or modified sequence opt3 from hemagglutinin__InfluenzaA__ADW82238

SEQ ID NO: 128465 - RNA, 1701 nt, Artificial Sequence; identical to SEQ ID NO: 124685
  derived and/or modified sequence opt3 from hemagglutinin__InfluenzaA__ADW82248

SEQ ID NO: 128466 - RNA, 1701 nt, Artificial Sequence; identical to SEQ ID NO: 124685
  derived and/or modified sequence opt3 from hemagglutinin__InfluenzaA__ADW82258

SEQ ID NO: 128467 - RNA, 1701 nt, Artificial Sequence
  derived and/or modified sequence opt3 from hemagglutinin__InfluenzaA__ADW82268
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggauccaucaaauucuggcuauauauucuacaguggcgucaaguuugguccucgugguuagccugggagcaaucuccuuuuggaugugcucuaacgguucguuacagugccggauuuguaucuga

SEQ ID NO: 128468 - RNA, 1701 nt, Artificial Sequence; identical to SEQ ID NO: 128455
  derived and/or modified sequence opt3 from hemagglutinin__InfluenzaA__ADW93760

SEQ ID NO: 128469 - RNA, 1701 nt, Artificial Sequence
  derived and/or modified sequence opt3 from hemagglutinin__InfluenzaA__ADW95319
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacgagaucacaaauaaggugaacagcguuauagagaaaaugaauacucaguuuaccgccguggggaaggaguucaaccaccuggagaagcggauugaaaauuuaaacaaaaaggucgaugacggcuuccuggauaucuggacauacaaugcugagcuccuugugcuguuggaaaacgagcgcacucuagacuaucaugauuccaauguaaagaaccuguacgagaagguucgaaaccagcucaaaaauaacgccaaggaaaucggaaauggcuguuuugaguucuaucacaagugcgacaacaccuguauggaaucugugaaaaaugggacauacgauuauccuaaguacagcgaggaagcaaaacugaacagagaggagauugacggagucaaacuugaaucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 128470 - RNA, 1701 nt, Artificial Sequence
  derived and/or modified sequence opt3 from hemagglutinin__InfluenzaA__ADW95332
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacaccuguauggagucugugaagaaugggacauacgauuauccuaaauacagcgaagaggcaaagcugaacagagaagagauugacggagucaaacuugagucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 128471 - RNA, 1701 nt, Artificial Sequence
  derived and/or modified sequence opt3 from hemagglutinin__InfluenzaA__ADX21078
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacaggugagaucugcgacagcccacaccagauucuagauggcaaaaauuguacccucaucgacgcucugcuuggggauccgcagugcgacggauuucaaaacaagaaaugggaucuguucgucgaaagauccaaggccuauucuaauuguuaccccuaugacgugccugauuacgcaucguugaggucacucguugccagcaguggcacucuggaguuuaacaaugaauccuucaacuggacaggugugacccagaaugggacgucuagcgcuugcauacggcgcuccaagaacucauuuuucagucgacugaauuggcucacucauuuaaacuuuaaauauaccgcacugaaugucacaaugccaaacaacgagcaguucgacaagcuguacaucuggggagugcaccaucccggcacugauaaagaccagauuuuucuuuaugcccaagcuagcggccguaucaccguaucuacaaagagaucccagcagaccguuauuccuaauaucgggucaaggccacgggugcgcaacauacccagcagaauuaguaucuacuggacgauugucaaaccuggagauauccugcuaaucaauucuacugguaaccucauugccccaaggggcuacuucaagauacgguccgggaaaagcucgaucaugcgcucugacgcgccgauuggaaaauguaauuccgagugcaucacacccaacggcucaauaccuaaugacaagccauuucagaacgugaaucgaauuaccuauggugcaugucccagauacgugaaacaaaacacucugaaguuggccacagggaugaggaaugucccugaaaaacagacccggggaaucuucggcgcuaucgccggcuuuauugagaacgggugggaaggaaugguugaugguugguauggcuuccgucaccagaauagugaggggcgcggacaagcagcugaccuuaagagcacgcaggccgcgaucgaucagauuaacggcaaauugaauagacucauaaggaagaccaacgagaaguuccaccagaucgaaaaagaguuuuccgaaguggagggucggauucaagaccuggaaaaguacguagaggauacaaaaaucgacuuauggucuuauaacgccgagcugcucguggcacuugaaaaucagcauacuaucgaucugaccgacagcgagaugaacaaguuguucgaaaagacaaagaagcagcuacgagagaaugcugaagauauggggaacggcugcuuuaaaauuuaccacaagugugacaaugccugcauaggaucaauccgcaacggcacuuaugaucaugacgucuacagagacgaggcucugaauaacagguuccagauuaaagggguggagcucaagaguggauacaaagauuggauccuguggauuuccuuugccaucagcugcuuccuucuguguguugcauugcucgguuuuauaaugugggccugccaaaagggcaauauccgguguaacauuugcaucuga

SEQ ID NO: 128472 - RNA, 1701 nt, Artificial Sequence; identical to SEQ ID NO: 128471
  derived and/or modified sequence opt3 from hemagglutinin__InfluenzaA__ADX21088

SEQ ID NO: 128473 - RNA, 1701 nt, Artificial Sequence
  derived and/or modified sequence opt3 from hemagglutinin__InfluenzaA__ADX21098
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcucuacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacgagaucacgaacaaggugaauagcguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucaaacguaaagaaucuguacgagaagguucgaagucagcucaaaaacaacgcaaaggaaaucggcaauggauguuuugaguucuaucacaagugcgacaacacauguauggaauccgugaaaaauggcacuuacgauuauccuaaguacagcgaggaagccaaacugaacagagaggagauugacggggucaaacuugaaucuaccaggauccaucaaauucuggcuauauauucaacaguggcgaguagcuugguccucgugguuucccugggagcaaucucuuuuuggaugugcucgaaugguagcuuacagugccggauuuguaucuga

SEQ ID NO: 128474 - RNA, 1701 nt, Artificial Sequence; identical to SEQ ID NO: 125604
  derived and/or modified sequence opt3 from hemagglutinin__InfluenzaA__ADX36109

SEQ ID NO: 128475 - RNA, 1701 nt, Artificial Sequence
  derived and/or modified sequence opt3 from hemagglutinin__InfluenzaA__ADX96278
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaggauuuuauaagaaucugauauggcuggugaaaaagggcaacaguuacccaaaacucagcaagucuuauaucaaugacaagggcaaagaaguauuaguucugugggggauucaccaccccuccacgucagcugaucaacagagccuuuaccagaacgccgacgcguacguguucgucggaaguucucgcuauuccaagaaauuuaagccugagaucgcaauucgaccaaaagugcgugaucaggaggguagaaugaauuacuauuggacuuugguggaacccggcgacaagaucaccuucgaggccacagggaaccuggucguuccuagguacgcuuuugccauggaacggaacgcaggaagcggcauaauuaucucggauacuccagugcaugacugcaauaccacaugucaaaccccgaaaggugcuguaaacacgucucuacccuuccagaauauucacccuaucacuaucgggaagugcccaaaguaugugaaauccacaaagcuccgccuggccaccggacuuagaaacguccccucaauucagaguaggggccuguuuggcgcgauagccggguucaucgagggagguuggacuggcaugguggacgggugguacggauaucaucaccagaaugaacaaggcagcgguuacgcagcugauuugaaauccacacagaacgccauugacgagaucaccaauaagguuaacucugugauagagaaaaugaauacgcaguuuaccgcugucgggaaggaguucaaccaccucgaaaagcggauugaaaaucugaacaaaaagguggaugacggcuucuuagauaucuggacauacaaugccgagcugcucguacuucuggaaaacgagcgcacuuuggacuaucaugauagcaauguuaaaaaccuauacgagaaggugcgaucacagcugaaaaacaaugcaaaggaagucggaaacggcuguuuugaguucuaucacaagugcgacaauaccuguauggaaagugugaaaaacgggacauacgauuauccuaaguacuccgaggaagccaaacucaauagagaggagaucgacggagucaagcuggaaagcacuaggauuuaucaaauccuugcuauuuacucuaccgcggcaucaagucugguguugguugugagccucggugccauauccuuuuggaugugcucuaacggcucgcugcagugccggaucuguauuuga

SEQ ID NO: 128476 - RNA, 1701 nt, Artificial Sequence
  derived and/or modified sequence opt3 from hemagglutinin__InfluenzaA__ADX96288
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaacaaggaaacagcuacccaaagcucucuaaauccuauaucaaugacaagggcaaggaaguauuaguucuguggggcauucaccaccccucaacgagcgcugaucagcagagucuuuaccagaacgccgacgcguacguguucgucgggucuucccgcuauagcaaaaaguuuaaaccugagaucgcaauucgaccaaaggugcgugaucaagagggaagaaugaauuacuauuggacuuugguggaacccggugacaaaaucaccuucgaggccacaggcaaccuggucguuccuagguacgcuuuugccauggaacggaacgcagggucgggaauaauuaucucugauacuccagugcaugacugcaauaccacaugucagaccccgaagggcgcuauuaacacgucccuacccuuccagaauauccacccuaucacuauugguaaaugcccaaaguauguaaagucaacaaaacuccgccuggccaccgggcuuagaaacgugcccaguauacagagcaggggacuguuuggcgcgaucgccggcuucauugaagggggauggacugguauggucgacggcugguacggguaucaucaccaaaaugaacagggauccggcuacgcagcugauuugaagucuacacagaacgccaucgacgagauaaccaauaaagugaacagcguuauugagaagaugaauacgcaguuuaccgcuguggguaaagaguucaaccaccucgagaagcggaucgaaaaucugaacaagaaagucgaugacggguucuuagauaucuggacauacaaugccgagcugcucgugcuucuggaaaacgagcgcacuuuggacuaucaugauucaaauguaaagaaccuauacgagaaaguucgaagucaacugaagaacaaugcaaaagaagugggcaacggauguuuugaguucuaucacaagugcgacaauaccuguauggaauccgucaagaacggcacauacgauuauccuaaauacagcgaggaagccaagcucaauagagaggagauugacggggugaaacuggaaucuacuaggaucuaucagauucuugcuauauacucaaccgcggcaaguagccuggucuuggugguuucccucggagccaucucuuuuuggaugugcucgaacgguagccugcagugccggauuuguaucuga

SEQ ID NO: 128477 - RNA, 1701 nt, Artificial Sequence
  derived and/or modified sequence opt3 from hemagglutinin__InfluenzaA__ADX96298
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgugauucgaccaaaagugcgugaucaggagggaagaaugaauuacuauuggaccuuggucgaacccggugacaagaucacauucgaggcaacuggcaaccugguugugccuagguacgccuuugcuauggaacggaacgccgggagcggaauaauuaucucggauaccccaguacaugacugcaauacaaccugucaaacgccgaaaggcgcaauuaacacuucucuacccuuccagaauauccacccuaucacaauugguaagugcccaaaguaugugaaauccaccaagcuccgccuggcuacugggcuuagaaacguccccucaauacagaguaggggacuguuuggcgccaucgcgggcuucauugaagggggauggacagguaugguggacggcugguacggguaucaucaccagaaugaacaaggaagcggcuacgccgcagauuugaaauccacccagaacgcuaucgacgagauaacgaauaagguuaacucugugauugagaaaaugaauacccaguuuacagccgucgguaaggaguucaaccaccucgagaagcggaucgaaaaucugaacaaaaagguggaugacggguucuuagauaucuggacuuacaaugcugagcugcucguacuucuggaaaacgagcgcaccuuggacuaucaugauagcaauguuaaaaaccuauacgagaaggugcgaucacagcugaaaaacaaugccaaggaaauuggcaacggauguuuugaguucuaucacaagugcgacaauacauguauggaaagugucaaaaacggcacuuacgauuauccuaaguacuccgaggaagcaaaacucaauagagaggagaucgacggggugaagcuggaaagcaccaggauuuaucaaauacuugccaucuacucuacagucgcuucaagucugguguugguugugagccucggagcgauuuccuuuuggaugugcucuaccgguucgcugcagugccggaucuguaucuga

SEQ ID NO: 128478 - RNA, 1701 nt, Artificial Sequence; identical to SEQ ID NO: 126282
  derived and/or modified sequence opt3 from hemagglutinin__InfluenzaA__ADX96308

SEQ ID NO: 128479 - RNA, 1701 nt, Artificial Sequence
  derived and/or modified sequence opt3 from hemagglutinin__InfluenzaA__ADX96318
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacaagaucacgaauaaagugaacagcguuauagagaagaugaauacccaguuuacagccguggguaaggaguucaaccaccuggaaaaacggauugagaauuuaaacaagaaagucgaugacggguuccuggauaucuggacuuacaaugcugaacuccuugugcuguuggagaacgaacgcacccuagacuaucaugauucaaauguaaagaaccuguacgagaaaguucgaagucagcucaagaacaaugccaaggagaucggcaacggauguuuugaguucuaucacaaaugcgacaauacauguauggaauccgugaagaacggcacuuacgauuauccuaaauacagcgaagaggcaaagcugaauagagaagagauugacggggucaaacuugagucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 128480 - RNA, 1701 nt, Artificial Sequence
  derived and/or modified sequence opt3 from hemagglutinin__InfluenzaA__ADX96328
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 128481 - RNA, 1701 nt, Artificial Sequence
  derived and/or modified sequence opt3 from hemagglutinin__InfluenzaA__ADX96347
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcauaauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128482 - RNA, 1701 nt, Artificial Sequence
  derived and/or modified sequence opt3 from hemagglutinin__InfluenzaA__ADX96357
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgugauucgaccaaaagugcgugaucaggagggaagaaugaauuacuauuggaccuuggucgaacccggugacaagaucacauucgaggcaacuggcaaccugguugugccuagguacgccuuugcuauggaacggaacgccgggagcggaauaauuaucucggauaccccaguacaugacugcaauacaaccugucaaacgccgaaaggcgcaauuaacacuucucuacccuuccagaauauccacccuaucacaauugguaagugcccaaaguaugugaaauccaccaagcuccgccuggcuacugggcuuagaaacguccccucaauacagaguaggggacuguuuggcgccaucgcgggcuucauugaagggggauggacagguaugguggacggcugguacggguaucaucaccagaaugaacaaggaagcggcuacgccgcagauuugaaauccacccagaacgcuaucgacgagauaacgaauaagguuaacucugugauugagaaaaugaauacccaguuuacagccgucgguaaggaguucaaccaccucgagaagcggaucgaaaaucugaacaaaaagguggaugacggguucuuagauaucuggacuuacaaugcugagcugcucguacuucuggaaaacgagcgcaccuuggacuaucaugauagcaauguuaaaaaccuauacgagaaggugcgaucacagcugaaaaacaaugccaaggaaauuggcaacggauguuuugaguucuaucacaagugcgacaauacauguauggaaagugucaaaaacggcacuuacgauuauccuaaguacuccgaggaagcaaaacucaauagagaggagaucgacggggugaagcuggaaagcaccaggauuuaucaaauacuugccaucuacucuacagucgcuucaagucugguguugguugugagccucggagcgauuuccuuuuggaugugcucuaacgguucgcugcagugccggaucuguaucuga

SEQ ID NO: 128483 - RNA, 1701 nt, Artificial Sequence; identical to SEQ ID NO: 127622
  derived and/or modified sequence opt3 from hemagglutinin__InfluenzaA__ADX96367

SEQ ID NO: 128484 - RNA, 1701 nt, Artificial Sequence
  derived and/or modified sequence opt3 from hemagglutinin__InfluenzaA__ADX96378
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccaauccaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 128485 - RNA, 1701 nt, Artificial Sequence; identical to SEQ ID NO: 128484
  derived and/or modified sequence opt3 from hemagglutinin__InfluenzaA__ADX96398

SEQ ID NO: 128486 - RNA, 1701 nt, Artificial Sequence
  derived and/or modified sequence opt3 from hemagglutinin__InfluenzaA__ADX96408
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccaauucaugacugcaauacaaccugucaaacgccgaaaggcgcuaucaacacuucucuacccuuccagaauauccacccuauuacaauagguaagugcccaaaguaugugaaauccaccaagcuccgccuggccacugggcuuagaaacguacccucaauccagaguaggggacuguuuggcgcgauugccggcuucaucgaagggggauggacagguaugguggacggcugguacggguaucaucaccagaaugaacaaggaagcggcuacgcagcugauuugaaauccacccagaacgccauagacgagauuacgaauaaggucaacucugugaucgagaaaaugaauacccaguuuacagcuguugguaaggaguucaaccaccucgagaagcggaucgaaaaucugaacaaaaagguggaugacggguucuuagauauuuggacuuacaaugccgagcugcucguccuucuggaaaacgagcgcaccuuggacuaucaugauagcaaugugaaaaaccuauacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacucaauagagaggagauugacggggugaagcuggaaagcaccaggauauaucaaauccuugcuauuuacucuacagucgcgucaagucugguguuggucgugagccucggagcaaucuccuuuuggaugugcucuaacgguucgcugcagugccggaucuguauuuga

SEQ ID NO: 128487 - RNA, 1701 nt, Artificial Sequence; identical to SEQ ID NO: 124998
  derived and/or modified sequence opt3 from hemagglutinin__InfluenzaA__ADX96427

SEQ ID NO: 128488 - RNA, 1701 nt, Artificial Sequence
  derived and/or modified sequence opt3 from hemagglutinin__InfluenzaA__ADX96437
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggcuggaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaagugggcaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacuaggauuuaucaaauccuggcuauuuacucaaccgcggcaaguagcuugguccucgugguuucccugggagccauaucuuuuuggaugugcucgaacgguagcuuacagugccggaucuguauuuga

SEQ ID NO: 128489 - RNA, 1701 nt, Artificial Sequence; identical to SEQ ID NO: 124672
  derived and/or modified sequence opt3 from hemagglutinin__InfluenzaA__ADX96447

SEQ ID NO: 128490 - RNA, 1701 nt, Artificial Sequence; identical to SEQ ID NO: 124685
  derived and/or modified sequence opt3 from hemagglutinin__InfluenzaA__ADX96497

SEQ ID NO: 128491 - RNA, 1701 nt, Artificial Sequence
  derived and/or modified sequence opt3 from hemagglutinin__InfluenzaA__ADX96507
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaccgguucguuacagugccggauuuguaucuga

SEQ ID NO: 128492 - RNA, 1701 nt, Artificial Sequence; identical to SEQ ID NO: 128491
  derived and/or modified sequence opt3 from hemagglutinin__InfluenzaA__ADX96517

SEQ ID NO: 128493 - RNA, 1701 nt, Artificial Sequence
  derived and/or modified sequence opt3 from hemagglutinin__InfluenzaA__ADX96527
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuuucacaagugcgacaauacauguauggaaagugugaaaaacggcacuuaugauuacccuaaguauuccgaggaagccaaacugaauagagaggagauugacggggucaaacuugaaagcaccaggaucuaccaaauucuggcuauauauucuacaguggcgucaaguuugguccucgugguuagccugggagcaaucuccuucuggaugugcucuaacgguucguuacagugccggauuuguaucuga

SEQ ID NO: 128494 - RNA, 1701 nt, Artificial Sequence; identical to SEQ ID NO: 124685
  derived and/or modified sequence opt3 from hemagglutinin__InfluenzaA__ADX96537

SEQ ID NO: 128495 - RNA, 1701 nt, Artificial Sequence; identical to SEQ ID NO: 124685
  derived and/or modified sequence opt3 from hemagglutinin__InfluenzaA__ADX96547

SEQ ID NO: 128496 - RNA, 1701 nt, Artificial Sequence; identical to SEQ ID NO: 125786
  derived and/or modified sequence opt3 from hemagglutinin__InfluenzaA__ADX96557

SEQ ID NO: 128497 - RNA, 1701 nt, Artificial Sequence; identical to SEQ ID NO: 124685
  derived and/or modified sequence opt3 from hemagglutinin__InfluenzaA__ADX96587

SEQ ID NO: 128498 - RNA, 1701 nt, Artificial Sequence; identical to SEQ ID NO: 124672
  derived and/or modified sequence opt3 from hemagglutinin__InfluenzaA__ADX96597

SEQ ID NO: 128499 - RNA, 1701 nt, Artificial Sequence; identical to SEQ ID NO: 124672
  derived and/or modified sequence opt3 from hemagglutinin__InfluenzaA__ADX96607

SEQ ID NO: 128500 - RNA, 1701 nt, Artificial Sequence
  derived and/or modified sequence opt3 from hemagglutinin__InfluenzaA__ADX96627
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggagaaaaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaguucaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaccgguucguuacagugcaggauuuguaucuga

SEQ ID NO: 128501 - RNA, 1701 nt, Artificial Sequence; identical to SEQ ID NO: 125132
  derived and/or modified sequence opt3 from hemagglutinin__InfluenzaA__ADX96637

SEQ ID NO: 128502 - RNA, 1701 nt, Artificial Sequence; identical to SEQ ID NO: 124685
  derived and/or modified sequence opt3 from hemagglutinin__InfluenzaA__ADX96647

SEQ ID NO: 128503 - RNA, 1701 nt, Artificial Sequence; identical to SEQ ID NO: 124672
  derived and/or modified sequence opt3 from hemagglutinin__InfluenzaA__ADX96657

SEQ ID NO: 128504 - RNA, 1701 nt, Artificial Sequence; identical to SEQ ID NO: 124685
  derived and/or modified sequence opt3 from hemagglutinin__InfluenzaA__ADX96667

SEQ ID NO: 128505 - RNA, 1701 nt, Artificial Sequence
  derived and/or modified sequence opt3 from hemagglutinin__InfluenzaA__ADX96677
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacuguggucgaacccggugacaagauuaccuucgaggccacaggcaaccugguugugccuagguacgcuuuugccauggaacggaacgcagggucgggaaucauaauuucugauacuccaguacaugacugcaauaccacaugucaaaccccgaaaggcgcuaucaacacgucccuacccuuccacaauauucauccuaucacuaucgguaagugcccaaaguaugugaaaucaacaaagcuccgccuggccaccgggcuuagaaacguccccaguauucagagcaggggacuguuuggcgcgauagccggcuucaucgaagggggauggacugguaugguggacggcugguacggguaucaccaccagaaugaacagggauccggcuacgcagcugauuugaaaucuacacaaaacgccauugacgagaucaccaauaagguuaacagcgugauagagaaaaugaauacgcaguuuaccgcugucgguaaggaguucaaccaucucgaaaagcggauugaaaaucugaacaaaaagguggaugacggguucuuagauaucuggacauacaaugccgagcugcucguacuucuggaaaacgagcgcacuuuggacuaucacgauucaaauguuaaaaaccuauacgagaaggugcgaagucagcugaaaaacaaugcaaaggaaaucggcaacggauguuuugaguucuaucauaagugcgacaauaccuguauggaauccgucaaaaacggcacauacgauuauccuaaguacagcgaggaagccaaacucaauagagaggagauugacggggugaagcuggaaucuacuaggaucuaucagauucuugcuauauacucaaccgucgcgaguagccugguguugguugugucccucggagcaaucucuuuuuggaugugcucgaacgguagccugcaaugccggauuuguaucuga

SEQ ID NO: 128506 - RNA, 1701 nt, Artificial Sequence
  derived and/or modified sequence opt3 from hemagglutinin__InfluenzaA__ADX96687
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucaagcgguuugaaauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccaguguaugacugcaauacaaccugucaaacgccgaagggcgcuaucaacacuucucuccccuuccagaauauucauccuaucacaaucgguaagugcccaaaauacguaaaguccaccaaacugcgccuugccacugggcugagaaacgugcccucaauucagaguaggggauuguuuggcgcgauagccggcuucaucgaagggggauggacagguauggucgacggcugguauggguaccaccaucagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuauaaugccgaacuccuugugcuguuggagaacgaacgcacccuagacuaccacgauagcaauguaaagaaccuguaugagaaaguucgaucacagcucaagaacaaugcaaaggagaucggcaacggauguuuugaguucuaccauaaaugcgacaauacauguauggagagugugaagaacggcacuuaugauuacccuaaauauuccgaagaggccaagcugaauagagaagagauugacggggucaaacuugagagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 128507 - RNA, 1701 nt, Artificial Sequence; identical to SEQ ID NO: 124685
  derived and/or modified sequence opt3 from hemagglutinin__InfluenzaA__ADX96697

SEQ ID NO: 128508 - RNA, 1701 nt, Artificial Sequence
  derived and/or modified sequence opt3 from hemagglutinin__InfluenzaA__ADX96707
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcgacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaccgguucguuacagugccggauuuguaucuga

SEQ ID NO: 128509 - RNA, 1701 nt, Artificial Sequence; identical to SEQ ID NO: 125845
  derived and/or modified sequence opt3 from hemagglutinin__InfluenzaA__ADX96727

SEQ ID NO: 128510 - RNA, 1701 nt, Artificial Sequence
  derived and/or modified sequence opt3 from hemagglutinin__InfluenzaA__ADX96737
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugaaggagcaggaaggacguaugaauuacuauuggacccugguggagcccggugauaaaauuacauucgaagccacuggcaaccuagucguuccuagauacgcuuuugccauggagaggaaggcagggagcggaaucauaauuucggacaccccagugcaugauugcaacacaaccugucaaacgccgaagggcgcuaucaauacuucucuccccuuccagaacauucacuccaucacaaucgguaaaugcccuaaguauguaaaaucaaccaagcugcggcuugccacugggcugcgcaaugugccaaguauucagagcagaggauuguuuggcgcgauagccggcuucaucgaagggggauggacagguauggucgacggcugguacggguaucaucaccagaacgagcaaggauccggcuacgcagcugaccucaaaucuacccagaaugccauugaugagaucacgaacaaggugaauagcguuauagaaaagaugaacacccaguuuacagcuguggguaaagaguucaaucaccuggaaaagaggauugagaacuuaaauaaaaaggucgacgauggguuccuggacaucuggacuuacaacgccgaacuccuugugcuguuggagaaugagcggacccuagauuaucaugacucaaacguaaagaaucuguacgaaaagguucgcagucagcucaagaacaacgcaaaagagaucggcaauggauguuuugaguucuaucacaagugcgauaacacauguauggaguccgugaaaaauggcacuuacgacuaucccaaguacagcgaagaggccaaacugaaccgagaggaaauugauggggucaaacuugagucuaccagaaucuaucaaauucuggcuauauacucaacaguggcgaguagcuugguccucgugaucucccugggagcaauuucuuuuuggaugugcucgaccgguagcuuacagugcaggaucuguaucuga

SEQ ID NO: 128511 - RNA, 1701 nt, Artificial Sequence; identical to SEQ ID NO: 124685
  derived and/or modified sequence opt3 from hemagglutinin__InfluenzaA__ADX96747

SEQ ID NO: 128512 - RNA, 1701 nt, Artificial Sequence
  derived and/or modified sequence opt3 from hemagglutinin__InfluenzaA__ADX96757
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccuggugguccccggcgauaagauuacauucgaagccacugggaaccuaguugugccuagguacgcuuuugccauggagcggaacgcaggaagcggcaucauaauuucggacaccccaguacaugauugcaauacaaccugucaaacgccgaaaggugcuaucaacacuucucuccccuuccagaauauucacccuaucacaaucgggaagugcccaaaguaugugaaauccaccaagcugcgccuugccacuggacugagaaacguccccucaauucagaguaggggcuuguuuggcgcgauagccggguucaucgaaggagguuggacaggcaugguggacgggugguacggauaucaucaccagaaugagcaaggcagcgguuacgcagcugaccucaaauccacccagaacgccauugaugaaaucacgaauaagguuaacucugugauagagaaaaugaauacccaguuuacagcugucgggaaggaguucaaccaccuggaaaagcggauugagaauuuaaacaaaaagguggacgauggcuuccuggacaucuggacuuacaaugccgaacuccuuguacuguuggagaacgaacgcacccuagauuaucaugacagcaauguuaaaaaccuguacgagaaggugcgaucacagcucaaaaacaaugcaaaggagaucggaaacggcuguuuugaguucuaucacaagugcgauaauacauguauggagagugucaaaaacgggacuuacgacuauccuaaguacuccgaagaggccaaacugaauagagaagagauugauggagugaaacuugagagcaccaggaucuaucaaauucuggcuauauacucuacagucgcgucaaguuuggugcucguugugagccugggugcaaucuccuuuuggaugugcucuaccggcucguuacagugccggauuuguaucuga

SEQ ID NO: 128513 - RNA, 1701 nt, Artificial Sequence
  derived and/or modified sequence opt3 from hemagglutinin__InfluenzaA__ADX96767
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaaagcggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguuaaaaagcuguacgagaaaguacgaagucagcucaagaacaacgcaaaggaaaucggcaauggauguuuugaguucuaucacaaaugcgacaacacauguauggaauccgugaagaauggcacuuacgauuaucccaaauacagcgaggaagccaagcugaacagagaggagauugacggggucaaacuugaaucuaccaggaucuaucaaauucuggcuauauacucaacaguggcgaguagcuugguccucgugguuucccugggagcaaucucuuuuuggaugugcucgaccgguagcuuacagugccggauuuguaucuga

SEQ ID NO: 128514 - RNA, 1701 nt, Artificial Sequence
  derived and/or modified sequence opt3 from hemagglutinin__InfluenzaA__ADX96777
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggugguccccggugacaagauuacauucgaagccacuggcaaccuaguugugccuagguacgcuuuugccauggagcggaacgcagggagcggaaucauaauuucggauaccccaguacaugacugcaauacaaccugucaaacgccgaaaggcgcuaucaacacuucucuccccuuccagaauauucacuccaucacaaucgguaagugcccuaaguaugugaaaucaaccaagcugcgccuugccacugggcugagaaacgucccaaguauucagagcaggggauuguuuggcgcgauagccggcuucaucgaagggggauggacagguaugguggacggcugguacggguaucaucaccagaaugagcaaggauccggcuacgcagcugaucucaaaucuacccagaacgccauugacgaaaucacgaauaagguuaacagcgugauagagaaaaugaauacccaguuuacagcugucgguaaggaguucaaccaccuggaaaagcggauugagaauuuaaacaaaaagguggaugacggguuccuggauaucuggacuuacaaugccgaacuccuuguacuguuggagaacgaacgcacccuagacuaucaugauucaaauguuaaaaaccuguacgagaaggugcgaagucagcucaaaaacaaugcaaaggagaucggcaacggauguuuugaguucuaucacaagugcgacaauacauguauggaguccgucaaaaacggcacuuacgauuaucccaaguacagcgaagaggccaaacugaauagagaagagauugacggggugaaacuugagucuaccaggaucuaucaaauucuggcuauauacucaacagucgcgaguagcuuggugcucguugugucccugggagcaaucucuuuuuggaugugcucgaacgguagcuuacagugccggauuuguaucuga

SEQ ID NO: 128515 - RNA, 1701 nt, Artificial Sequence; identical to SEQ ID NO: 124685
  derived and/or modified sequence opt3 from hemagglutinin__InfluenzaA__ADX96787

SEQ ID NO: 128516 - RNA, 1701 nt, Artificial Sequence; identical to SEQ ID NO: 127912
  derived and/or modified sequence opt3 from hemagglutinin__InfluenzaA__ADX96797

SEQ ID NO: 128517 - RNA, 1701 nt, Artificial Sequence
  derived and/or modified sequence opt3 from hemagglutinin__InfluenzaA__ADX96807
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuuuagcaagaaauucaagccugagaucgcaauucgaccaaaagugcgugaucaggagggaagaaugaauuauuacuggacuuugguggaacccggugacaagaucaccuuugaggccacaggcaaccuggucguuccuagguaugcuuucgccauggaacggaacgcagggucgggaauaauuaucucugauacuccagugcaugacugcaauaccacaugucaaaccccgaaaggcgcuauuaacacgucccuacccuuucagaauauccacccuaucacuauugguaagugcccaaaguacguaaaaucaacaaagcuccgccuggccaccgggcuuagaaacgugcccaguauacagagcaggggacuguucggcgcgaucgccggcuuuauugaagggggauggacugguauggucgacggcugguauggguaccaucaccagaaugaacaaggauccggcuaugcagcugauuugaaaucuacacagaacgccaucgacgagauaaccaauaaggugaacagcguuauugagaaaaugaauacgcaguucaccgcuguggguaaggaguucaaccaccucgagaagcggaucgaaaaucugaacaaaaaggucgaugacggguuuuuagauaucuggacauacaaugccgagcugcucgugcuucuggaaaacgagcgcacuuuggacuaccaugauucaaauguuaaaaaccuauaugagaagguacgaagucagcugaaaaacaaugcaaaggaagugggcaacggauguuucgaguuuuaccacaagugcgacaauaccuguauggaauccgucaaaaacggcacauaugauuacccuaaguauagcgaggaagccaaacucaauagagaggagauugacggggugaagcuggaaucuacuaggaucuaccaaauucuugcuauauauucaaccgucgcgaguagccugguguugguugugucccucggagcaaucucuuucuggaugugcucgaacgguagccugcagugccggauuuguaucuga

SEQ ID NO: 128518 - RNA, 1701 nt, Artificial Sequence; identical to SEQ ID NO: 124672
  derived and/or modified sequence opt3 from hemagglutinin__InfluenzaA__ADX96817

SEQ ID NO: 128519 - RNA, 1701 nt, Artificial Sequence
  derived and/or modified sequence opt3 from hemagglutinin__InfluenzaA__ADX96837
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccuuaugcaggggccaaaaguuuuuacaagaaucugauauggcuggugaaaaagggaaacagcuauccaaaacucucuaaguccuacaucaaugacaagggcaaagaaguauuaguucuguggggcauucaucaccccucaacgagcgcugaucaacagagucuuuaccagaacgccgacgcguauguguucgucgggucuucccgcuacagcaagaaauuuaagccugagaucgcaauucgaccaaaagugcgugaucaggagggaagaaugaauuauuacuggacuuugguggaacccggugacaagaucaccuucgaggccacaggcaaccuggucguuccuagguaugcuuuugccauggaacggaacgcagggucgggaauaauuaucucugauacuccagugcacgacugcaauaccacaugucaaaccccgaaaggcgcuauuaacacgucccuacccuuccagaauauccauccuaucacuauugguaagugcccaaaguacguaaaaucaacaaagcuccgccuggccaccgggcuuagaaacgugcccaguauacagagcaggggacuguuuggcgcgaucgccggcuucauugaagggggauggacugguauggucgacggcugguauggguaccaccaucagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauauaaugccgagcugcucgugcuucuggaaaacgagcgcacuuuggacuaccacgauucaaauguuaaaaaccuauaugagaagguacgaagucagcugaaaaacaaugcaaaggaagugggcaacggauguuuugaguucuaccauaagugcgacaauaccuguauggaauccgucaaaaacggcacauaugauuacccuaaguauagcgaggaagccaaacucaauagagaggagauugacggggugaagcuggaaucuacuaggaucuaccaaauucuugcuauauacucaaccgucgcgaguagccugguguugguugugucccucggagcaaucucuuuuuggaugugcucgacagguagccugcagugccggauuuguaucuga

SEQ ID NO: 128520 - RNA, 1701 nt, Artificial Sequence; identical to SEQ ID NO: 124685
  derived and/or modified sequence opt3 from hemagglutinin__InfluenzaA__ADX96847

SEQ ID NO: 128521 - RNA, 1701 nt, Artificial Sequence; identical to SEQ ID NO: 124685
  derived and/or modified sequence opt3 from hemagglutinin__InfluenzaA__ADX96857

SEQ ID NO: 128522 - RNA, 1701 nt, Artificial Sequence; identical to SEQ ID NO: 124865
  derived and/or modified sequence opt3 from hemagglutinin__InfluenzaA__ADX96867

SEQ ID NO: 128523 - RNA, 1701 nt, Artificial Sequence; identical to SEQ ID NO: 127622
  derived and/or modified sequence opt3 from hemagglutinin__InfluenzaA__ADX96877

SEQ ID NO: 128524 - RNA, 1701 nt, Artificial Sequence
  derived and/or modified sequence opt3 from hemagglutinin__InfluenzaA__ADX96897
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccaauccaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 128525 - RNA, 1701 nt, Artificial Sequence
  derived and/or modified sequence opt3 from hemagglutinin__InfluenzaA__ADX96907
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacucugggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaacuugcuauccaggcgauuuuaucgacuacgaggagcucagggagcagcugaguuccgugucuagcuucgaacgguuugagauuuucccgaagacauccucauggcccaaccacgauaguagcaagggugucaccgccgcuuguccucaugcaggggccaaaucuuuuuauaagaaucugaucuggcucgugaaaaagggaaacuccuacccaaaauuaucaaagagcuauauaaaugacaagggcaaagaaguacugguucuuuggggcauccaccaccccaguacgucugcugaucaacaguccuuguaccagaacgccgacgcguacguguucgucgggacuagccgcuauucgaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaaugcagggucuggaaucauaauuuccgauaccccagugcaugacugcaacacaaccugucaaacgccgaaaggcgcuaucaacacuucacuccccuuccagaauauucacccuaucacaaucgguaagugcccaaaguauguaaaaaguaccaagcugcgccuugccacugggcugagaaacgugcccagcauucaguccaggggauuguuuggcgcgauagccggcuucaucgaagggggauggacagguauggucgacggcugguacggguaucaucaccagaaugaacaaggaucuggcuacgcagcugaucucaaaagcacccagaacgccauugacaagaucacgaauaaagugaacucaguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauaguaauguaaagaaccuguacgagaaaguucgaucccagcucaagaauaacgcaaaggagaucggcaacggauguuuugaguucuaucacaaaugcgacaauacauguauggaaagcgugaagaacggcacuuacgauuauccuaaauacucugaagaggccaagcugaauagagaagagauugacggggucaaacuugagucaaccaggaucuaucaaauucuggcuauauacaguacaguggcgagcuccuugguccucgugguuucucugggagcaaucucguuuuggaugugcagcaacgguuccuuacagugccggauuuguaucuga

SEQ ID NO: 128526 - RNA, 1701 nt, Artificial Sequence
  derived and/or modified sequence opt3 from hemagglutinin__InfluenzaA__ADX96927
augaaggccauccuggugguccuccuuuacaccuucgcuacagcaaacgccgacacucugugcauuggcuaucacgcgaauaacagcacggauaccguugacacauuguuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaagaacugagggagcagcugagcaguguuuccucuuucgaacgguuugagauuuucccgaagacaagcuccuggcccaaucacgauucaaacaagggugugaccgccgcuuguccucaugcaggggccaaaaguuuuuauaagaaucucaucugguuagucaaaaagggaaacagcuacccaaaacugucuaaguccuauauaaaugacaagggcaaagaagugcuuguauuguggggcauccaccaccccucaacgagcgcugaucaacagagucuguaccagaacgccgacgcguacguuuucguggggacuucucgcuauuccaagaaauuuaagccugagauugcaauccgaccaaaaguccgugaucaggagggaagaaugaauuacuauuggacccuaguggaacccggugacaagauuacauucgaggccacuggcaaccucguggucccuagguacgcuuuugccauggaucggaacgcagggagcggaaucauaauuucggacaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggauggcugguacggguaucaucaccagaaugagcaaggaagcggcuacgcagcugaccugaaguccacccagaacgccauugaugaaaucacgaauaaggucaacucugugauagagaaaaugaauacccaguuuacagcuguugguaaggaguucaaccacuuagaaaagcggauugagaaucugaacaaaaagguggacgauggguuccucgacaucuggacuuacaaugccgaacuucuggucuugcuagagaacgaacgcacccuggauuaucaugacagcaaugugaaaaaccucuacgagaagguacgaucacagcugaaaaacaaugcaaaggagaucggcaacggauguuuugaguucuaucacaagugcgauaauacauguauggagaguguuaaaaacggcacuuacgacuauccuaaguacuccgaagaggccaaacuuaauagagaagagauugauggggugaagcuggagagcaccaggaucuaucaaauuuuggcuauauacucuacagucgcgucaagucucgugcuggucgugagcuuaggagcaaucuccuuuuggaugugcucuaacgguucgcugcagugccggauuuguaucuga

SEQ ID NO: 128527 - RNA, 1701 nt, Artificial Sequence; identical to SEQ ID NO: 126105
  derived and/or modified sequence opt3 from hemagglutinin__InfluenzaA__ADX96937

SEQ ID NO: 128528 - RNA, 1701 nt, Artificial Sequence; identical to SEQ ID NO: 124672
  derived and/or modified sequence opt3 from hemagglutinin__InfluenzaA__ADX96947

SEQ ID NO: 128529 - RNA, 1701 nt, Artificial Sequence; identical to SEQ ID NO: 125849
  derived and/or modified sequence opt3 from hemagglutinin__InfluenzaA__ADX96957

SEQ ID NO: 128530 - RNA, 1701 nt, Artificial Sequence; identical to SEQ ID NO: 124998
  derived and/or modified sequence opt3 from hemagglutinin__InfluenzaA__ADX96967

SEQ ID NO: 128531 - RNA, 1701 nt, Artificial Sequence; identical to SEQ ID NO: 124865
  derived and/or modified sequence opt3 from hemagglutinin__InfluenzaA__ADX96977

SEQ ID NO: 128532 - RNA, 1701 nt, Artificial Sequence
  derived and/or modified sequence opt3 from hemagglutinin__InfluenzaA__ADX96987
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacgggauuaagcuggaaucuacuaggauauaucaaauccuugcuauuuacucaaccgucgcgaguagccugguguuggucgugucccucggagcaaucucuuuuuggaugugcucgaacgguagccugcagugccggaucuguauuuga

SEQ ID NO: 128533 - RNA, 1701 nt, Artificial Sequence; identical to SEQ ID NO: 124865
  derived and/or modified sequence opt3 from hemagglutinin__InfluenzaA__ADX96997

SEQ ID NO: 128534 - RNA, 1701 nt, Artificial Sequence
  derived and/or modified sequence opt3 from hemagglutinin__InfluenzaA__ADX97007
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggaugcuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacgagaucaccaauaaggugaacucuguuauagagaaaaugaauacgcaguuuaccgccguggguaaggaguucaaccaccuggaaaagcggauugaaaauuuaaacaaaaaggucgaugacggguuccuggauaucuggacauacaaugcagagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagagaggagauugacggggucaaacuugaaagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 128535 - RNA, 1701 nt, Artificial Sequence; identical to SEQ ID NO: 128484
  derived and/or modified sequence opt3 from hemagglutinin__InfluenzaA__ADX97018

SEQ ID NO: 128536 - RNA, 1701 nt, Artificial Sequence
  derived and/or modified sequence opt3 from hemagglutinin__InfluenzaA__ADX97028
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaacaaggaaacagcuacccaaagcucucuaaauccuauaucaaugacaagggcaaggaaguauuaguucuguggggcauucaccaccccucaacgacugcugaucagcagagccuuuaccagaacgccgacgcguacguguucgucgggaguucucgcuauuccaaaaaguuuaaaccugagaucgcaauucgaccaaaggugcgugaucaagagggaagaaugaauuacuauuggaccuugguggaacccggugacaaaaucacauucgaggccacuggcaaccuggucguuccuagguacgcuuuugccauggaacggaacgcagggagcggaauaauuaucucggauaccccagugcaugacugcaauacaaccugucagacgccgaagggcgcuauuaacacuucucuacccuuccagaauauccacccuaucacaauugguaaaugcccaaaguauguaaaguccaccaaacuccgccuggccacugggcuuagaaacgugcccucaauacagaguaggggacuguuuggcgcgaucgccggcuucauugaagggggauggacagguauggucgacggcugguacggguaucaucaccaaaaugaacagggaagcggcuacgcagcugauuugaaguccacccagaacgccaucgacgagauaacgaauaaagugaacucuguuauugagaagaugaauacccaguuuacagcuguggguaaagaguucaaccaccucgagaagcggaucgaaaaucugaacaagaaagucgaugacggguucuuagauaucuggacuuacaaugccgagcugcucgugcuucuggaaaacgagcgcaccuuggacuaucaugauagcaauguaaagaaccuauacgagaaaguucgaucacaacugaagaacaaugcaaaagaagugggcaacggauguuuugaguucuaucacaagugcgacaauacauguauggaaagugucaagaacggcacuuacgauuauccuaaauacuccgaggaagccaagcucaauagagaggagauugacggggugaaacuggaaagcaccaggaucuaucagauucuugcuauauacucuacagcggcaucaagucuggucuuggugguuagccucggagccaucuccuuuuggaugugcucuaacgguucgcugcagugccggauuuguaucuga

SEQ ID NO: 128537 - RNA, 1701 nt, Artificial Sequence; identical to SEQ ID NO: 127238
  derived and/or modified sequence opt3 from hemagglutinin__InfluenzaA__ADX98640

SEQ ID NO: 128538 - RNA, 1701 nt, Artificial Sequence; identical to SEQ ID NO: 126237
  derived and/or modified sequence opt3 from hemagglutinin__InfluenzaA__ADX98650

SEQ ID NO: 128539 - RNA, 1701 nt, Artificial Sequence
  derived and/or modified sequence opt3 from hemagglutinin__InfluenzaA__ADX98665
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugauggagucaaacuugaaagcaccaggaucuaucaaauucuggcuauauacucuacagcggcaucaaguuuggugcucgucgugagccugggugccaucuccuuuuggaugugcucuaacggcucguuacagugccggauuuguaucuga

SEQ ID NO: 128540 - RNA, 1701 nt, Artificial Sequence; identical to SEQ ID NO: 125849
  derived and/or modified sequence opt3 from hemagglutinin__InfluenzaA__ADX98675

SEQ ID NO: 128541 - RNA, 1701 nt, Artificial Sequence; identical to SEQ ID NO: 125849
  derived and/or modified sequence opt3 from hemagglutinin__InfluenzaA__ADX98695

SEQ ID NO: 128542 - RNA, 1701 nt, Artificial Sequence; identical to SEQ ID NO: 126237
  derived and/or modified sequence opt3 from hemagglutinin__InfluenzaA__ADX98729

SEQ ID NO: 128543 - RNA, 1701 nt, Artificial Sequence; identical to SEQ ID NO: 127568
  derived and/or modified sequence opt3 from hemagglutinin__InfluenzaA__ADX98739

SEQ ID NO: 128544 - RNA, 1701 nt, Artificial Sequence; identical to SEQ ID NO: 127317
  derived and/or modified sequence opt3 from hemagglutinin__InfluenzaA__ADX98748

SEQ ID NO: 128545 - RNA, 1701 nt, Artificial Sequence; identical to SEQ ID NO: 124685
  derived and/or modified sequence opt3 from hemagglutinin__InfluenzaA__ADX98758

SEQ ID NO: 128546 - RNA, 1701 nt, Artificial Sequence; identical to SEQ ID NO: 125038
  derived and/or modified sequence opt3 from hemagglutinin__InfluenzaA__ADX98767

SEQ ID NO: 128547 - RNA, 1701 nt, Artificial Sequence; identical to SEQ ID NO: 126282
  derived and/or modified sequence opt3 from hemagglutinin__InfluenzaA__ADX98777

SEQ ID NO: 128548 - RNA, 1701 nt, Artificial Sequence
  derived and/or modified sequence opt3 from hemagglutinin__InfluenzaA__ADX98785
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaauagcuccccuucaucuggguaaaugcaacaucgccggcuggauuuuggggaauccugagugugaaucucucucaacagcaaguagcugguccuacaucguggagaccucuucgucagacaacggaacuugcuauccaggcgauuucauugacuacgaggagcugagggagcagcugagcaguguuuccucuuuugaacgguucgagaucuuuccgaagacaagcuccuggcccaaucacgauucaaacaagggugugaccgccgcuuguccucaugcaggggccaaaaguuucuauaagaaucucauaugguuagucaaaaagggaaacagcuacccaaaacugucuaaguccuauaucaaugacaagggcaaagaagugcuuguauuguggggcauucaccaccccucaacgagcgcugaucaacagagucuguaccagaacgccgacgcguacguuuuuguggggacuucucgcuauuccaagaaauucaagccugagaucgcaauucgaccaaaaguccgugaucaggagggaagaaugaauuacuauuggacccuaguggaacccggugacaagaucacauuugaggccacuggcaaccucguggucccuagguacgcuuucgccauggaacggaacgcagggagcggaauaauuaucucggauaccccaguucaugacugcaauacaaccugucaaacgccgaaaggcgcuauuaacacuucucugcccuuucagaauauccacccuaucacaauugguaagugcccaaaguaugugaaauccaccaaacuucgccuggccacuggguugagaaacguacccucaauacagaguaggggacucuucggcgcgaucgccggcuuuauugaagggggauggacagguaugguggacggcugguacggguaucaucaccagaaugaacaaggaagcggcuacgcagcugaucugaaguccacccagaacgccaucgacgagauaacgaauaaggucaacucugugauugagaaaaugaauacccaguucacagcuguugguaaggaauuuaaccacuuagagaagcggaucgaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaauuggcaacggauguuucgaguuuuaucacaagugcgacaauacauguauggaaaguguuaaaaacggcacuuacgauuauccuaaguacuccgaggaagccaaacuuaauagagaggagaucgggggagugaagcuggaaagcaccaggauuuaucaaauauuggcuaucuacucuacagucgcgucaagucucgugcuggucgugagcuuaggugcaauuuccuucuggaugugcucuaacggcucgcugcagugccggaucuguaucuga

SEQ ID NO: 128549 - RNA, 1701 nt, Artificial Sequence; identical to SEQ ID NO: 125786
  derived and/or modified sequence opt3 from hemagglutinin__InfluenzaA__ADX98792

SEQ ID NO: 128550 - RNA, 1701 nt, Artificial Sequence; identical to SEQ ID NO: 125786
  derived and/or modified sequence opt3 from hemagglutinin__InfluenzaA__ADX98806

SEQ ID NO: 128551 - RNA, 1701 nt, Artificial Sequence; identical to SEQ ID NO: 127726
  derived and/or modified sequence opt3 from hemagglutinin__InfluenzaA__ADX98818

SEQ ID NO: 128552 - RNA, 1701 nt, Artificial Sequence; identical to SEQ ID NO: 124685
  derived and/or modified sequence opt3 from hemagglutinin__InfluenzaA__ADX98828

SEQ ID NO: 128553 - RNA, 1701 nt, Artificial Sequence; identical to SEQ ID NO: 128076
  derived and/or modified sequence opt3 from hemagglutinin__InfluenzaA__ADX98843

SEQ ID NO: 128554 - RNA, 1701 nt, Artificial Sequence
  derived and/or modified sequence opt3 from hemagglutinin__InfluenzaA__ADX98853
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaauugcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuaccauuggacucugguggaacccggugacaagaucaccuucgaggccacaggcaaccuagucguuccuagguaugcuuuugccauggaacggaacgcagggagcggaauaauuaucucggauacuccagugcacgacugcaauaccacaugucaaaccccgaaaggcgcuauuaacacgucucuccccuuccagaauauccauccuaucacuauugguaagugcccaaaguacguaaaauccacaaagcugcgccuugccaccgggcugagaaacgugcccucaauacagaguaggggauuguuuggcgcgaucgccggcuucauugaagggggauggacugguauggucgacggcugguauggguaccaccaccagaaugaacaaggaagcggcuaugcagcugaucucaaauccacacagaacgccaucgacaagauaaccaauaaagugaacucuguuauugagaagaugaauacgcaguuuaccgcuguggguaaggaguucaaccaucuggaaaaacggaucgagaauuuaaacaagaaagucgaugacggguuccuggauaucuggacauacaaugccgaacuccuugugcuguuggagaacgaacgcacucuagacuaccacgauagcaauguaaagaaccuguaugagaaaguucgaucacagcucaagaacaaugcaaaggagauuggcaacggauguuuugaguucuaccauaaaugcgacaauaccuguauggaaagugugaagaacggcacauaugauuacccuaaauauuccgaagaggccaagcugaauagagaagagaucgacggggucaaacuugagagcacuaggauuuaccaaauacuggcuaucuauucuaccguggcgucaaguuugguccucgugguuagccugggagcaauuuccuuuuggaugugcucuaacgguucguuacagugccggaucuguaucuga

SEQ ID NO: 128555 - RNA, 1701 nt, Artificial Sequence; identical to SEQ ID NO: 125849
  derived and/or modified sequence opt3 from hemagglutinin__InfluenzaA__ADX98860

SEQ ID NO: 128556 - RNA, 1701 nt, Artificial Sequence; identical to SEQ ID NO: 127237
  derived and/or modified sequence opt3 from hemagglutinin__InfluenzaA__ADX98870

SEQ ID NO: 128557 - RNA, 1701 nt, Artificial Sequence
  derived and/or modified sequence opt3 from hemagglutinin__InfluenzaA__ADX98880
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuauaauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 128558 - RNA, 1701 nt, Artificial Sequence
  derived and/or modified sequence opt3 from hemagglutinin__InfluenzaA__ADX98890
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagagagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacaagaucacgaauaaagugaacucuguuauagagaagaugaauacccaguuuacagcugugggcaaggaguucaaccaccuggagaaacggauugaaaauuuaaacaagaaagucgaugacgguuuccuggauaucuggacuuacaaugccgagcuccuugugcuguuggaaaacgagcgcacccuagacuaucaugauagcaauguaaagaaccuguacgagaaaguucgaucacagcucaagaacaaugcaaaggaaaucgggaacggcuguuuugaguucuaucacaaaugcgacaauacauguauggaaagugugaagaacggaacuuacgauuauccuaaauacuccgaggaagccaagcugaauagagaggagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 128559 - RNA, 1701 nt, Artificial Sequence; identical to SEQ ID NO: 126237
  derived and/or modified sequence opt3 from hemagglutinin__InfluenzaA__ADX98900

SEQ ID NO: 128560 - RNA, 1701 nt, Artificial Sequence
  derived and/or modified sequence opt3 from hemagglutinin__InfluenzaA__ADX98910
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaauuaguuggagcuacaucguugagaccuccucuucggacaacggaacuugcuauccaggcgauuuuauugacuacgaggagcucagggagcagcugucaagcgugaguuccuucgaacgguuugagaucuucccgaagacaucuagcuggcccaaucacgauuccaacaagggugucaccgccgcuuguccucaugcaggggccaaaucauuuuauaagaaucugauauggcucgugaaaaagggaaacaguuacccaaaauuaagcaagucuuauaucaaugacaagggcaaagaaguacugguucuuuggggcauucaccaccccuccacgucagcugaucaacagagcuuguaccagaacgccgacgcguacguguucgucgggaccagucgcuauucuaagaaauuuaagccugagaucgcaauucgaccaaaagugcgugaucaggagggaagaaugaauuacuauuggacucugguggaacccggugacaagaucacauucgaggccacuggcaaccuagucguuccuagguacgcuuuugccauggaacggaacgcaggguccggaauaauuaucagcgauaccccagugcaugacugcaauacaaccugucaaacgccgaaaggcgcuauuaacacuucgcuccccuuccagaauauccacccuaucacaauugguaagugcccaaaguauguaaaaucuaccaagcugcgccuugccacugggcugagaaacgugcccuccauacagucaaggggauuguuuggcgcgaucgccggcuucauugaagggggauggacagguauggucgacggcugguacggguaucaucaccagaaugaacaaggaaguggcuacgcagcugaucucaaaagcacccagaacgccaucgacaagauaacgaauaaagugaacuccguuauugagaagaugaauacccaguuuacagcuguggguaaggaguucaaccaccuggaaaaacggaucgagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagauuggcaacggauguuuugaguucuaucacaaaugcgacaauacauguauggaaucagugaagaacggcacuuacgauuauccuaaauacagugaagaggccaagcugaauagagaagagaucgacggggucaaacuugaguccaccaggauuuaucaaauacuggcuaucuacagcacaguggcgucuucauugguccucgugguuagucugggagcaauuagcuuuuggaugugcuccaacgguucuuuacagugccggaucuguaucuga

SEQ ID NO: 128561 - RNA, 1701 nt, Artificial Sequence; identical to SEQ ID NO: 126237
  derived and/or modified sequence opt3 from hemagglutinin__InfluenzaA__ADX98920

SEQ ID NO: 128562 - RNA, 1701 nt, Artificial Sequence; identical to SEQ ID NO: 125849
  derived and/or modified sequence opt3 from hemagglutinin__InfluenzaA__ADX98930

SEQ ID NO: 128563 - RNA, 1701 nt, Artificial Sequence; identical to SEQ ID NO: 125476
  derived and/or modified sequence opt3 from hemagglutinin__InfluenzaA__ADX98940

SEQ ID NO: 128564 - RNA, 1701 nt, Artificial Sequence; identical to SEQ ID NO: 127305
  derived and/or modified sequence opt3 from hemagglutinin__InfluenzaA__ADX98950

SEQ ID NO: 128565 - RNA, 1701 nt, Artificial Sequence; identical to SEQ ID NO: 127286
  derived and/or modified sequence opt3 from hemagglutinin__InfluenzaA__ADX98960

SEQ ID NO: 128566 - RNA, 1701 nt, Artificial Sequence
  derived and/or modified sequence opt3 from hemagglutinin__InfluenzaA__ADX98970
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagggguuguaccagaacgccgacgcguacguguucgucggaaccagucgcuauucuaagaaauuuaagccugagauugcaauccgaccaaaagugcgugaucaggaggguagaaugaauuacuauuggacucugguggaacccggcgacaagauuacauucgaggccacugggaaccuagucguuccuagguacgcuuuugccauggaacggaacgcaggauccggcaucauaauuagcgauaccccagugcaugacugcaauacaaccugucaaacgccgaaaggugcuaucaacacuucgcuccccuuccagaauauucacccuaucacaaucgggaagugcccaaaguauguaaaaucuaccaagcugcgccuugccacuggacugagaaacauucccuccauacagucaaggggcuuguuuggcgcgaucgccggguucauugagggagguuggacaggcaugguggacgggugguacggauaucaucaccagaaugaacaaggcagugguuacgcagcugaucucaaaagcacccagaacgccaucgacaagauaacgaauaaagucaacuccgugauugagaagaugaauacccaguuuacagcuguugggaaggaguucaaccaccuggaaaaacggaucgagaauuuaaacaagaaaguggaugacggcuuccuggauaucuggacuuacaaugccgaacuccuuguccuguuggagaacgaacgcacccuagacuaucaugauucuaaugugaagaaccuguacgagaaaguacgaagccagcucaagaacaaugcaaaggagauuggaaacggcuguuuugaguucuaucacaaaugcgacaauacauguauggagucaguuaagaacgggacuuacgauuauccuaaauacagugaagaggccaagcugaauagagaagagaucgacggagugaaacuugaguccaccaggauuuaucaaauacuggcuaucuacagcacagucgcgucuucauuggugcucgucgugagucugggugcaauuagcuuuuggaugugcuccaacggcucuuuacagugccggaucuguaucuga

SEQ ID NO: 128567 - RNA, 1701 nt, Artificial Sequence; identical to SEQ ID NO: 125786
  derived and/or modified sequence opt3 from hemagglutinin__InfluenzaA__ADX98980

SEQ ID NO: 128568 - RNA, 1701 nt, Artificial Sequence; identical to SEQ ID NO: 124685
  derived and/or modified sequence opt3 from hemagglutinin__InfluenzaA__ADX98990

SEQ ID NO: 128569 - RNA, 1701 nt, Artificial Sequence; identical to SEQ ID NO: 125849
  derived and/or modified sequence opt3 from hemagglutinin__InfluenzaA__ADX99000

SEQ ID NO: 128570 - RNA, 1698 nt, Artificial Sequence
  derived and/or modified sequence opt3 from hemagglutinin__InfluenzaA__ADX99581
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguagacugaaaggaauagcaccccuucagcuggguaagugcaacaucgccggcugguugcucgggaauccugagugugauccacugcugccggucaggaguuggagcuauauuguggaaacucccaacuccgagaauggaaucugcuacccuggcgacuucauugauuaugaagaacuccgggagcaauuaucuucgguuaguagcuuugaacgcuucgagaucuuuccaaaagaaaguuccuggcccaaccauaauaccaacggugugacagcugcauguucucacgagggaaagagcuccuucuaccgaaaucugcuuugguugaccgagaaggaagggucauauccuaaacugaagaacaguuacgucaauaaaaagggcaaagaggugcuaguacucuggggcauacaucacccacccaacagcaaggaacagcagaaccuguaucagaaugagaacgccuacguuucuguggucacuuccaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucucaagaggcuucgggagcggaaucauaacuucaaacgccucuaugcacgaaugcaauaccaagugucagacaccucugggcgcaauuaacuccagcuuaccauaccagaauauccaucccgugacuauuggugagugcccuaaauaugucaggucggcuaagcugcggaugguuaccgggcuccgcaacacaccaucuauccagucccgaggacuuuuuggcgccaucgcgggcuucauugaagggggauggaccgguaugauagacggcugguacggguaucaccaucaaaaugagcagggaucaggcuacgccgcagaucagaaaaguacgcagaacgcuaucaaugguauuacuaacaaggugaacacaguaaucgagaaaaugaauauacaauuuaccgccguggggaaggaguucaacaagcuggagaaaagaauggaaaauuugaacaagaaagucgacgauggcuuucuagacauuuggacuuacaaugcugagcugcucgugcugcuugaaaacgagaggacacuggacuuccacgauagcaauguuaagaacuuguaugaaaaagugaagucccagcucaagaauaacgccaaagagaucggaaauggcuguuucgaguuuuaccacaagugcgacaacgaauguauggagucuguccggaaugggaccuaugauuaccccaaauauagcgaagagucaaagcugaaccgugagaaaguggacggaguaaaguuagaaaguauggguaucuaccagauucuggcaaucuauuccacgguugccagcucucuagugcuccuggucucacuuggcgcuauuaguuucuggaugugcagcaauggguccuugcaaugccgcauauguaucuga

SEQ ID NO: 128571 - RNA, 1698 nt, Artificial Sequence; identical to SEQ ID NO: 128570
  derived and/or modified sequence opt3 from hemagglutinin__InfluenzaA__ADX99592

SEQ ID NO: 128572 - RNA, 1698 nt, Artificial Sequence; identical to SEQ ID NO: 128570
  derived and/or modified sequence opt3 from hemagglutinin__InfluenzaA__ADX99603

SEQ ID NO: 128573 - RNA, 1698 nt, Artificial Sequence
  derived and/or modified sequence opt3 from hemagglutinin__InfluenzaA__ADX99614
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguagacugaaaggaauagcaccccuucagcuggguaagugcaacaucgccggcugguugcucgggaauccugagugugauccacugcugccggucaggaguuggagcuauauuguggaaacucccaacuccgagaauggaaucugcuacccuggcgacuucauugauuaugaggagcuccgggagcaauuaucuucgguuaguagcuuugaacgcuucgagaucuuuccaaaagaaaguuccuggcccaaccauaauaccaacggugugacagcugcauguucucacgagggaaagagcuccuucuaccgaaaucugcuuugguugaccgagaagaaagggucauauccuaagcugaaaaacaguuacgucaauaagaaaggcaaggaagugcuaguacucuggggcauacaucacccacccaacagcaaggagcagcagaaccuguaucagaaugaaaacgccuacguuucuguggucacuuccaauuacaaccguagauuuacaccugagaucgcugaaaggccaaaagugcgggaccaagccgggcgcaugaauuauuacuggacccuucugaagccgggagauacgauuaucuucgaggcgaacgguaauuugauugcacccauguaugccuuugcucucucaagaggcuucgggagcggaaucauaacuucaaacgccucuaugcacgagugcaauaccaaaugucagacaccucugggcgcaauuaacuccagcuuaccauaccagaauauccaucccgugacuauuggugaaugcccuaaguaugucaggucggcuaaacugcggaugguuaccgggcuccgcaacacaccaucuauccagucccgaggacuuuuuggcgccaucgcgggcuucauugaagggggauggaccgguaugauagacggcugguacggguaucaccaucaaaaugaacagggaucaggcuacgccgcagaucagaagaguacgcagaacgcuaucaaugguauuacuaacaaagugaacacaguaaucgagaagaugaauauacaauuuaccgccguggggaaggaguucaacaaacuggaaaagagaauggagaauuugaacaaaaaggucgacgauggcuuucuagacauuuggacuuacaaugcugaacugcucgugcugcuugagaacgaaaggacacuggacuuccacgauagcaauguuaaaaacuuguaugagaaggugaagucccagcucaaaaauaacgccaaggaaaucggaaauggcuguuucgaguuuuaccacaaaugcgacaacgaguguauggaaucuguccggaaugggaccuaugauuaccccaaguauagcgaggaaucaaaacugaaccgugagaagguggacggaguaaaguuagagaguauggguaucuaccagauucuggcaaucuauuccacgguugccagcucucuagugcuccuggucucacuuggcgcuauuaguuucuggaugugcagcaauggguccuugcaaugccgcauauguaucuga

SEQ ID NO: 128574 - RNA, 1698 nt, Artificial Sequence
  derived and/or modified sequence opt3 from hemagglutinin__InfluenzaA__ADX99625
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguagacugaaaggaauagcaccccuucagcuggguaagugcaacaucgccggcugguugcucgggaauccugagugugauccacugcugccggucaggaguuggagcuauauuguggaaacucccaacuccgagaauggaaucugcuacccuggcgacuucauugauuaugaagaacuccgggagcaauuaucuucgguuaguagcuuugaacgcuucgagaucuuuccaaaagaaaguuccuggcccaaccauaauaccaacggugugacagcugcauguucucacgagggaaagagcuccuucuaccgaaaucugcuuugguugaccgagaaggaagggucauauccuaaacugaagaacaguuacgucaauaaaaagggcaaagaggugcuaguacucuggggcauacaucacccacccaacagcaaggaacagcagaaccuguaucagaaugagaacgccuacguuucuguggucacuuccaauuacaaccguagauuuacaccugaaaucgcugagaggccaaaggugcgggaccaagccgggcgcaugaauuauuacuggacccuucugaaaccgggagauacgauuaucuucggugcgaacggcaauuugauugcacccauguaugccuuugcucucucaagaggguucggaagcggcaucauaacuucaaacgccucuaugcacgagugcaauaccaagugucagacaccucugggugcaauuaacuccagcuuaccauaccagaauauccaucccgugacuauuggggaaugcccuaaauaugucaggucggcuaagcugcggaugguuaccggacuccgcaacacaccaucuauccagucccgaggccuuuuuggcgccaucgcgggguucauugagggagguuggaccggcaugauagacgggugguacggauaucaccaucaaaaugaacagggcucagguuacgccgcagaucagaaaaguacgcagaacgcuaucaaugggauuacuaacaaggugaacacaguaaucgagaaaaugaauauacaauuuaccgccgugggcaaggaguucaacaagcuggagaaaagaauggagaauuugaacaagaaagucgacgauggauuucuagacauuuggacuuacaaugcugaacugcucgugcugcuugagaacgaaaggacacuggacuuccacgauagcaauguuaagaacuuguaugagaaagugaagucccagcucaagaauaacgccaaagaaaucggcaauggguguuucgaguuuuaccacaagugcgacaacgaguguauggaaucuguccggaauggaaccuaugauuaccccaaauauagcgaggaaucaaagcugaaccgugagaaaguggacgguguaaaguuagagaguaugggcaucuaccagauucuggcaaucuauuccacgguugccagcucucuagugcuccuggucucacuuggggcuauuaguuucuggaugugcagcaauggauccuugcaaugccgcauauguaucuga

SEQ ID NO: 128575 - RNA, 1698 nt, Artificial Sequence
  derived and/or modified sequence opt3 from hemagglutinin__InfluenzaA__ADX99636
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguagacugaaaggaauagcaccccuucagcuggguaagugcaacaucgccggcugguugcucgggaauccugagugugauccacugcugccggucaggaguuggagcuauauuguggaaacucccaacuccgagaauggaaucugcuacccuggcgacuucauugauuaugaggagcuccgggagcaauuaucuucgguuaguagcuuugaacgcuucgagaucuuuccaaaagaaaguuccuggcccaaccauaauaccaacggugugacagcugcauguucucacgagggaaagagcuccuucuaccgaaaucugcuuugguugaccaagaaagaggggucauauccuaagcugaaaaacaguuacgucaauaagaaaggcaaggaagugcuaguacucuggggcauacaucacccacccaacagcaaggagcagcagaaccuguaucagaaugaaaacgccuacguuucuguggucacuuccaauuacaaccguagauuuacaccugagaucgcugaaaggccaaaagugcgggaccaagccgggcgcaugaauuauuacuggacccuucugaagccgggagauacgauuaucuucgaggcgaacgguaauuugauugcacccauguaugccuuugcucucucaagaggcuucgggagcggaaucauaacuucaaacgccucuaugcacgagugcaauaccaaaugucagacaccucugggcgcaauuaacuccagcuuaccauaccagaauauccaucccgugacuauuggugaaugcccuaaguaugucaggucggcuaaacugcggaugguuaccgggcuccgcaacacaccaucuauccagucccgaggacuuuuuggcgccaucgcgggcuucauugaagggggauggaccgguaugauagacggcugguacggguaucaccaucaaaaugaacagggaucaggcuacgccgcagaucagaagaguacgcagaacgcuaucaaugguauuacuaacaaagugaacacaguaaucgagaagaugaauauacaauuuaccgccguggggaaggaguucaacaaacuggaaaagagaauggagaauuugaacaaaaaggucgacgauggcuuucuagacauuuggacuuacaaugcugaacugcucgugcugcuugagaacgaaaggacacuggacuuccacgauagcaauguuaaaaacuuguaugagaaggugaagucccagcucaaaaauaacgccaaggaaaucggaaauggcuguuucgaguuuuaccacaaaugcgacaacgaguguauggaaucuguccggaaugggaccuaugauuaccccaaguauagcgaggaaucaaaacugaaccgugagaagguggacggaguaaaguuagagaguauggguaucuaccagauucuggcaaucuauuccacgguugccagcucucuagugcuccuggucucacuuggcgcuauuaguuucuggaugugcagcaauggguccuugcaaugccgcauauguaucuga

SEQ ID NO: 128576 - RNA, 1698 nt, Artificial Sequence; identical to SEQ ID NO: 125294
  derived and/or modified sequence opt3 from hemagglutinin__InfluenzaA__ADX99647

SEQ ID NO: 128577 - RNA, 1698 nt, Artificial Sequence
  derived and/or modified sequence opt3 from hemagglutinin__InfluenzaA__ADX99680
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguugguccaaccauaauaccaacggugugacagcugcaugcucucacgaggggaagaguuccuucuaccgaaaucugcuuugguugaccgagaaggaaggaucauaucccaaacugaagaacaguuacgucaauaaaaagggcaaagaggugcuaguacucuggggcauacaucacccuccaaacagcaaggaacagcagaaccuguaucagaaugagaacgccuacguuucuguggucacuuccaauuacaaccguagauuuacacccgaaaucgcugagaggccuaaggugcgggaccaagccgggcgcaugaauuauuacuggacccuucugaaaccaggagauacgauuaucuucgaggcgaacgguaauuugauugcaccgauguaugccuuugcucucucaagaggcuucgggagcggaaucauaacuagcaacgccucuaugcacgaauguaauaccaagugccagacaccccugggcgcaauuaacuccagcuuaccuuaccagaauauccauccagugacuauuggugagugucccaaauaugucaggucggcuaagcugcggaugguuaccgggcuccgcaacaucccuucuauccagucccgaggacuuuuuggcgccauugcgggcuucauagaagggggauggacagguaugaucgacggcugguacggguaucaccaucaaaaugagcagggaucaggcuacgccgcagaucagaaaaguacccagaacgcuauuaaugguaucacgaacaaggugaacacuguaauagagaaaaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggacuuccacgauagcaauguuaagaacuuguaugaaaaagugaagucccagcucaagaauaacgccaaagagaucggaaauggcugcuucgaguuuuaccacaagugugacaacgaaugcauggagucuguccggaaugggacauaugauuacccaaaauauagcgaagagucaaagcugaaccgugagaaaguggacggaguaaaguuagaaaguauggguauuuaccagauccuggcaauuuauuccaccguugccagcucucuagugcuccuggucucacuuggcgcuauaaguuucuggaugugcagcaauggguccuugcaaugucgcaucugcauuuga

SEQ ID NO: 128578 - RNA, 1698 nt, Artificial Sequence
  derived and/or modified sequence opt3 from hemagglutinin__InfluenzaA__ADX99702
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaaaucauacgucaacaagaaaggcaaggaggugcuaguacucuggggcauacaucacccacccaauaguaaggaacagcagaaccuguaucagaacgagaaugccuacguuagcguggucacuucuaacuacaaucguagauuuacaccugaaaucgcugagaggccaaaagugcgggaccaagccgggcgcaugaacuauuacuggacccuucugaagccgggagauacgauuaucuucgaggcgaaugguaacuugauugcacccauguaugccuuugcucucuccagaggcuucgggucaggaaucauaacuagcaaugccaguaugcacgaauguaacaccaaaugccagacaccucugggcgcaauuaauucuuccuuaccauaccagaacauccaucccgugacuauuggugaguguccuaaguaugucaggagcgcuaaacugcggaugguuaccgggcuccgcaauaucccaucgauccagucucgaggacuuuuuggcgccauugcgggcuucauagaagggggauggacagguaugaucgacggcugguacggguaucaccaucaaaacgagcagggauccggcuacgccgcagaucagaagucaacccagaaugcuauuaacgguaucacgaauaaagugaacacuguaauagaaaagaugaacauucaauuuacagccguggggaaggaguucaauaaacuggagaagagaauggaaaacuugaauaaaaaggucgacgauggcuuucuagacaucuggaccuacaacgcugagcugcucgugcugcuugaaaaugagaggacucuggacuuccacgauaguaacguuaaaaauuuguaugaaaaggucaagagccagcucaaaaacaaugccaaggagaucggaaacggcugcuucgaguuuuaccacaaaugugacaaugaaugcauggaguccgugcggaacgggacauaugauuaccccaaguauucugaagagagcaaacugaaucgugagaagguggacggaguaaaguuagaaucaauggguauuuaccagauccuggcaauuuauaguaccguugccuccagccuagugcuccuggucucucuuggcgcuauaucauucuggaugugcaguaacgggagcuugcaaugucgcaucugcauuuga

SEQ ID NO: 128579 - RNA, 1698 nt, Artificial Sequence; identical to SEQ ID NO: 128578
  derived and/or modified sequence opt3 from hemagglutinin__InfluenzaA__ADX99843

SEQ ID NO: 128580 - RNA, 1698 nt, Artificial Sequence
  derived and/or modified sequence opt3 from hemagglutinin__InfluenzaA__ADX99854
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuaucugaaacuaaagaacucauacgucaauaaaaagggcaaagaggugcucguacuguggggcauacaucacccuccaaacaguaaggaacagcagaaccuuuaucagaaugagaacgccuacguuagcguggucacuucuaauuacaaccguagauuuacacccgaaaucgcugagaggccuaaggugcgggaccaagccgggcgcaugaauuauuacuggacccuguugaaaccaggagauacgauuaucuucgaggcgaacgguaaucucauugcaccgauguaugccuuugcucuguccagaggcuucgggucaggaaucauaacuagcaacgccaguaugcacgaauguaauaccaagugccagacacccuuaggcgcaauuaacucuucccugccuuaccagaauauccauccagugacuauuggugagugucccaaauaugucaggagcgcuaagcuccggaugguuaccgggcuucgcaacaucccuucgauccagucucgaggacuguuuggcgccauugcgggcuucauagaagggggauggacagguaugaucgacggcugguacggguaucaccaucaaaaugagcagggauccggcuacgccgcagaucagaaaucaacccagaacgcuauuaaugguaucacgaacaaggugaacacuguaauagagaaaaugaauauucaauuuacagccguggggaaggaguucaacaaguuggagaaaagaauggaaaaucuaaacaagaaagucgacgauggcuuucuggacaucuggaccuacaaugcugagcuccuggugcuucuggaaaacgagaggacuuuggacuuccacgauaguaauguuaagaaccucuaugaaaaagucaagagccagcugaagaauaacgccaaagagaucggaaauggcugcuucgaguuuuaccacaagugugacaacgaaugcauggaguccgugcggaaugggacauaugauuacccaaaauauucugaagagagcaaguuaaaccgugagaaaguggacggaguaaagcuggaaucaauggguauuuaccagauccuagcaauuuauaguaccguugccuccagccucgugcugcuugucucuuugggcgcuauaucauucuggaugugcaguaaugggagccugcaaugucgcaucugcauuuga

SEQ ID NO: 128581 - RNA, 1698 nt, Artificial Sequence
  derived and/or modified sequence opt3 from hemagglutinin__InfluenzaA__ADX99865
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacagaagaacucauacgucaauaaaaagggcaaagaggugcugguacuauggggcauacaucacccacccaacaguaaggaacagcagaaccucuaucaaaaugagaacgccuacguuagcguggucacuucuaauuacaaccguagauuuacaccugaaaucgcugagaggccaaaggugcgggaccaggccgggcgcaugaauuauuacuggacccugcuuaaaccgggagauacgauuaucuucgaggcgaacgguaaucugauugcacccauguaugccuuugcuuuguccagaggcuucgggucaggaaucauaacuagcaacgccaguaugcacgaauguaauaccaagugccagacaccucucggcgcaauuaacucuucccugccauaccagaauauccaucccgugacuauuggugaguguccuaaauaugucaggagcgcuaaguuacggaugguuaccgggcugcgcaacaucccaucgauccaaucucgaggacucuuuggcgccauugcgggcuucauagaagggggauggacagguaugaucgacggcugguacggguaucaccaucagaaugagcagggauccggcuacgccgcagaucagaaaucaacccaaaacgcuauuaaugguaucacgaacaaggugaacacuguaauagaaaagaugaauauucaguuuacagccguggggaaggaguucaacaaacuugagaaaagaauggaaaaucugaacaagaaagucgacgauggcuuuuuggacaucuggaccuacaaugcugagcuacuggugcuccuggaaaacgagaggacucuugacuuccacgauaguaauguuaagaaccuguaugaaaaagucaagagccaguugaagaauaacgccaaagagaucggaaauggcugcuucgaguuuuaccacaagugugacaacgaaugcauggaguccgugcggaaugggacauaugauuaccccaaauauucugaagagagcaagcucaaccgugagaaaguggacggaguaaagcuggaaucaauggguauuuaccaaaucuuagcaauuuauaguaccguugccuccagccuggugcuacucgucucucugggcgcuauaucauucuggaugugcaguaaugggagccuucagugucgcaucugcauuuga

SEQ ID NO: 128582 - RNA, 1698 nt, Artificial Sequence
  derived and/or modified sequence opt3 from hemagglutinin__InfluenzaA__ADX99887
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggagcuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacuggagaacucauacgucaauaagaaaggcaaggaagugcuaguacucuggggcauacaucacccacccaacaguaaagagcagcagaaccuguaucagaaugaaaacgccuacguuagcguggucacuucuaauuacaaccguagauuuacaccugagaucgcugagagguccaaggugcgggaccaagccgggcgcaugaauuauuacuggacccuucugaagccaggagauacgauuaucuucgaagcgaacgguaauuugauugcaccgauguaugccuuugcucucucaagaggcuucgggagcggaaucauaaccaguaacgccucuaugcacgaguguaauacuaaaugccagacaccccugggcgcaauuaacuccagcuuaccuuaccagaauauccauccagugacuauuggugaaugucccaaguaugucaggucggcuaaacugcggaugguuaccgggcuccgcaacaucccuucuauccagucccgaggacuuuuuggcgccauugcgggcuucauagaagggggauggacagguaugaucgacggcugguacggguaucaccaucaaaaugaacagggaucaggcuacgccgcagaucagaagaguacccagaacgcuauuaaugguaucacgaacaaagugaacacuguaauagagaagaugaauauucaauuuacagccguggggaaagaguucaacaagcuggaaaagagaauggagaauuugaacaaaaaggucgacgauggcuuucuagacaucuggaccuacaaugcugaacugcucgugcugcuugagaacgaaaggacucuggacuuccacgauagcaauguuaaaaacuuguaugagaaggugaaaucccagcucaagaauaacgccaaggagaucggaaauggcugcuucgaauuuuaccacaaaugugacaacgagugcauggaaucuguccggaaugggacauaugauuacccaaaguauagcgaggagucaaaacugaaccgugaaaagguggacggaguaaaauuagagaguauggguauuuaccagauccuggcaauuuauuccaccguugccagcucucuagugcuccuggucucacuuggcgcuauaaguuucuggaugugcagcaauggguccuugcaaugucgcaucugcauuuga

SEQ ID NO: 128583 - RNA, 1698 nt, Artificial Sequence
  derived and/or modified sequence opt3 from hemagglutinin__InfluenzaA__ADX99898
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacuacuaugucaauaaaaagggcaaagaggugcuaguacucuggggcauacaucacccacccaacucaaaggaacagcagaaccuguaccagaaugagaacgccuacguuaguguggucacuagcaauuauaaccguagauuuacaccugaaaucgcugagaggccaaaggugcgggaccaagccgggcgcaugaauuacuauuggacccuucugaaaccgggagauacgauuaucuucgaggcgaacgguaauuugauugcacccauguacgccuuugcucucucuagaggcuucggguccggaaucauaacuucaaacgccagcaugcacgaauguaauaccaagugccagacaccucugggcgcaauuaacaguucuuuaccauaucagaauauccaucccgugacuauuggugaguguccuaaauacgucagguccgcuaagcugcggaugguuaccgggcuccgcaacaucccaagcauccagucgcgaggacuuuuuggcgccauugcgggcuucauagaagggggauggacagguaugaucgacggcugguauggguaccaccaucaaaaugagcagggaucuggcuacgccgcagaucagaaauccacccagaacgcuauuaaugguaucacgaacaaggugaacacuguaauagagaaaaugaauauucaauuuacagccguggggaaggaguucaacaagcuggagaaaagaauggaaaauuugaacaagaaagucgacgauggcuuucuagacaucuggaccuauaaugcugagcugcucgugcugcuugaaaacgagaggacucuggacuuccacgauucaaauguuaagaacuuguacgaaaaagugaagagucagcucaagaauaacgccaaagagaucggaaauggcugcuucgaguuuuaucacaagugugacaacgaaugcauggagagcguccggaaugggacauacgauuaucccaaauacuccgaagagucuaagcugaaccgugagaaaguggacggaguaaaguuagaaagcauggguauuuaucagauccuggcaauuuacucaaccguugccaguucccuagugcuccuggucagccuuggcgcuauaucuuucuggaugugcucaaaugggaguuugcaaugucgcaucugcauuuga

SEQ ID NO: 128584 - RNA, 1698 nt, Artificial Sequence
  derived and/or modified sequence opt3 from hemagglutinin__InfluenzaA__ADX99909
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacuuuuacgucaauaaaaagggcaaagaggugcuaguacucuggggcauacaucacccacccaacucaaaggaacagcagaaccuguaucagaaugagaacgccuacguuaguguggucacuagcaauuacaaccguagauucacaccugaaaucgcugagaggccaaaggugcgggaccaagccgggcgcaugaauuauuacuggacccuucugaaaccgggagauacgauuaucuuugaggcgaacgguaauuugauugcacccauguaugccuucgcucucucuagaggcuuuggguccggaaucauaacuucaaacgccagcaugcacgaauguaauaccaagugccagacaccucugggcgcaauuaacaguucuuuaccauaccagaauauccaucccgugacuauuggugaguguccuaaauaugucagguccgcuaagcugcggaugguuaccgggcuccgcaacaucccaagcauccagucgcgaggacuuuucggcgccauugcgggcuuuauagaagggggauggacagguaugaucgacggcugguacggguaucaccaucaaaaugagcagggaucuggcuacgccgcagaucagaaauccacccagaacgcuauuaaugguaucacgaacaaggugaacacuguaauagagaaaaugaauauucaauucacagccguggggaaggaguuuaacaagcuggagaaaagaauggaaaauuugaacaagaaagucgacgauggcuuccuagacaucuggaccuacaaugcugagcugcucgugcugcuugaaaacgagaggacucuggacuuccacgauucaaauguuaagaacuuguaugaaaaagugaagagucagcucaagaauaacgccaaagagaucggaaauggcugcuuugaguucuaccacaagugugacaacgaaugcauggagagcguccggaaugggacauaugauuaccccaaauauuccgaagagucuaagcugaaccgugagaaaguggacggaguaaaguuagaaagcauggguauuuaccagauccuggcaauuuauucaaccguugccaguucccuagugcuccuggucagccuuggcgcuauaucuuuuuggaugugcucaaaugggaguuugcaaugucgcaucugcauuuga

SEQ ID NO: 128585 - RNA, 1698 nt, Artificial Sequence; identical to SEQ ID NO: 128584
  derived and/or modified sequence opt3 from hemagglutinin__InfluenzaA__ADX99920

SEQ ID NO: 128586 - RNA, 1698 nt, Artificial Sequence
  derived and/or modified sequence opt3 from hemagglutinin__InfluenzaA__ADX99931
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacuggagaacucauacgucaauaagaaaggcaaggaagugcuaguacucuggggcauacaucacccacccaacaguaaagagcagcagaaccuguaucagaaugaaaacgccuacguuagcguggucacuucuaauuacaaccguagauuuacaccugagaucgcugggaggccaaaggugcgggaccaagccggacgcaugaauuauuacuggacccuucugaagccgggugauacgauuaucuucgaggcgaacggcaauuugauugcacccauguaugccuuugcucucuccagaggguucggaucaggcaucauaacuagcaacgccaguaugcacgaauguaauaccaaaugccagacaccucugggugcaauuaacucuuccuuaccauaccagaauauccaucccgugacuauuggggaguguccuaaguaugucaggagcgcuaaacugcggaugguuaccggacuccgcaacaucccaucgauccagucucgaggccuuuuuggcgccauugcgggguucauagaaggagguuggacaggcaugaucgacgggugguacggauaucaccaucaaaaugagcagggcuccgguuacgccgcagaucagaagucaacccagaacgcuauuaaugggaucacgaacaaagugaacacuguaauagaaaagaugaauauucaauuuacagccgugggcaaagaguucaacaagcuggagaagagaauggaaaauuugaacaaaaaggucgacgauggauuucuagacaucuggaccuacaaugcugagcugcucgugcugcuugaaaacgagaggacucuggacuuccacgauaguaauguuaaaaacuuguaugaaaaggugaaaagccagcucaagaauaacgccaaggagaucggcaaucggugcuucgaguuuuaccacaaaugugacaacgaaugcauggaguccguccguaaugggacauaugauuaccccaaguauucugaagagagcaaacugaaccgcgagaagguggacggaguaaaauuagaaucaauggguauuuaccagauccuggcaauuuauaguaccguugccuccagccuagugcuccuggucucucuuggcgcuauaucauucuggaugugcaguaaugggagcuugcaauguagaaucugcauuuga

SEQ ID NO: 128587 - RNA, 1698 nt, Artificial Sequence
  derived and/or modified sequence opt3 from hemagglutinin__InfluenzaA__ADX99964
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaagcauaacaccaauggugugacagcugcaugcucccacgaggggaagucuagcuucuaccgaaaccugcuuugguugaccgagaaagaaggauccuauccuaagcugaaaaauucauacgucaacaagaaaggcaaggaggugcuaguacucuggggcauacaucacccacccaauaguaaggaacagcagaaccuguaucagaacgagaaugccuacguuagcguggucacuucuaacuacaaucguagauuuacaccugaaaucgcugagaggccaaaagugcgggaccaagccgggcgcaugaacuauuacuggacccuucugaagccgggagauacgauuaucuucgaggcgaaugguaacuugauugcacccauguaugccuuugcucucuccagaggcuucgggucaggaaucauaacuagcaaugccaguaugcacgaauguaacaccaaaugccagacaccucugggcgcaauuaauucuuccuuaccauaccagaacauccaucccgugacuauuggugaguguccuaaguaugucaggagcgcuaaacugcggaugguuaccgggcuccgcaauaucccaucgauccagucucgaggacuuuuuggcgccauugcgggcuucauagaagggggauggacagguaugaucgacggcugguacggguaucaccaucaaaacgagcagggauccggcuacgccgcagaucagaagucaacccagaaugcuauuaacgguaucacgaauaaagugaacacuguaauagaaaagaugaacauucaauuuacagccguggggaaggaguucaauaaacuggagaagagaauggaaaacuugaauaaaaaggucgacgauggcuuucuagacaucuggaccuacaacgcugagcugcucgugcugcuugaaaaugagaggacucuggacuuccacgauaguaacguuaaaaauuuguaugaaaaggucaagagccagcucaaaaacaaugccaaggagaucggaaacggcugcuucgaguuuuaccacaaaugugacaaugaaugcauggaguccgugcggaacgggacauaugauuaccccaaguauucugaagagagcaaacugaaucgugagaagguggacggaguaaaguuagaaucaauggguauuuaccagauccuggcaauuuauaguaccguugccuccagccuagugcuccuggucucucuuggcgcuauaucauucuggaugugcaguaacgggagcuugcaaugucgcaucugcauuuga

SEQ ID NO: 128588 - RNA, 1698 nt, Artificial Sequence
  derived and/or modified sequence opt3 from hemagglutinin__InfluenzaA__ADX99975
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggagcuccgggagcaauuauccucuguuucgucauuugaacgcuucgagaucuuuccaaaagaaagcaguuggcccaaccauaauaccaacggugugacagcuaccugcucccacgaggggaagucuagcuucuaccgaaaucugcuuugguugacugagaaggaaggauccuauccugagcugaaaaacucauacgucaauaagaaaggcaaggaagugcuaguacucuggggcauacaucacccacccaacaguaaagagcagcagaaccuguaucagaaugaaaacgcauacguuagcguggucacaucuaauuacaaccguagauuuaccccugagaucgccgagaggccaaaggugcgggaccaagcugggcgcaugaauuauuacuggacgcuucugaagccgggagauacuauuaucuucgaagccaacgguaauuugauugcgcccauguaugcauuugcccucuccagaggcuucgggucaggaaucauaaccagcaacgcuaguaugcacgaguguaauacaaaaugccagacuccucugggcgccauuaacucuuccuuaccauaccagaauauccaucccgugaccauuggugaauguccuaaguaugucaggagcgcaaaacugcggaugguuacagggcuccgcaacaucccaucgauccagucucgaggacuuuuuggcgcuauugccggcuucauagaagggggauggaccgguaugaucgacggcugguacggguaucaccaucaaaaugaacagggauccggcuacgcggccgaucagaagucaacgcagaacgcaauuaaugguaucacuaacaaagugaacacaguaauagagaagaugaauauucaauuuaccgcuguggggaaagaguucaacaagcuggaaaagagaauggagaauuugaacaaaaaggucgacgauggcuuucuagacaucuggacuuacaaugccgaacugcucgugcugcuugagaacgaaaggacacuggacuuccacgauaguaauguuaaaaacuuguaugagaaggugaaaagccagcucaagaauaacgcuaaggagaucggaaauggcugcuucgaauuuuaccacaaaugugacaacgagugcauggaauccguccggaaugggaccuaugauuaccccaaguauucugaggagagcaaacugaaccgugaaaagguggacggaguaaaauuagagucaauggguauuuaccagauccuggccauuuauaguacgguugcauccagccuagugcuccuggucucucuuggcgccauaucauucuggaugugcaguaaugggagcuugcaaugucgcaucugcauuuga

SEQ ID NO: 128589 - RNA, 1698 nt, Artificial Sequence
  derived and/or modified sequence opt3 from hemagglutinin__InfluenzaA__ADX99986
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccuaaaugcgauccacugcugccggucaggucauggaguuauauuguggagacucccaacagcgaaaauggaaucuguuacccuggcgacuucauugauuaugaggaacuccgggagcaauuauccucuguuucgucauuugagcgcuucgaaaucuuuccaaaggagagcaguuggcccaaccauaauaccaacggugugacagcugcaugcucccacgaagggaagucuagcuucuaccgaaaucugcuuugguugaccgagaaagagggauccuauccuaagcuggaaaacucauacgucaauaaaaagggcaaagaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucuccagaggcuucgggucaggaaucauaacuagcaacgccaguaugcacgaauguaauaccaagugccagacaccucugggcgcaauuaacucuuccuuaccauaccagaauauccaucccgugacuauuggugaguguccuaaauaugucaggagcgcuaagcugcggaugguuaccgggcuccgcaacaucccaucgauccagucucgaggacuuuuuggcgccauugcgggcuucauagaagggggauggacagguaugaucgacggcugguacggguaucaccaucaaaaugagcagggauccggcuacgccgcagaucagaaaucaacccagaacgcuauuaaugguaucacgaacaaggugaacacuguaauagaaaagaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggacuuccacgauaguaauguuaagaacuuguaugaaaaagugaaaagccagcucaagaauaacgccaaagagaucggaaauggcugcuucgaguuuuaccacaagugugacaacgaaugcauggaguccguccggaaugggacauaugauuaccccaaauauucugaagagagcaagcugaaccgugagaaaguggacggaguaaaguuagaaucaauggguauuuaccagauccuggcaauuuauaguaccguugccuccagccuagugcuccuggucucucuuggcgcuauaucauucuggaugugcaguaaugggagcuugcaaugucgcaucugcauuuga

SEQ ID NO: 128590 - RNA, 1698 nt, Artificial Sequence
  derived and/or modified sequence opt3 from hemagglutinin__InfluenzaA__ADX99997
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggagcuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacuggagaacucauacgucaauaagaaaggcaaggaagugcuaguacucuggggcauacaucacccacccaacaguaaagagcagcagaaccuguaucagaaugaaaacgccuacguuagcguggucacuucuaauuacaaccguagauuuacaccugagaucgcugagaggccaaaggugcgggaccaagccgggcgcaugaaguauuacuggacccuucugaaaccgggagauacgauuaucuucgaagcgaaugguaacuugauugcacccauguaugccuuugcucucuccagaggcuucgggucaggaaucauaacuagcaaugccaguaugcacgaguguaacaccaagugccagacaccucugggcgcaauuaauucuuccuuaccauaccagaacauccaucccgugacuauuggugaauguccuaaauaugucaggagcgcuaagcugcggaugguuaccgggcuccgcaauaucccaucgauccagucucgaggacuuuuuggcgccauugcgggcuucauagaagggggauggacagguaugaucgacggcugguacggguaucaccaucaaaacgaacagggauccggcuacgccgcagaucagaaaucaacccagaaugcuauuaacgguaucacgaauaaggugaacacuguaauagagaaaaugaacauucaauuuacagccguggggaaggaguucaauaagcuggaaaagagaauggagaacuugaauaagaaagucgacgauggcuuucuagacaucuggaccuacaacgcugaacugcucgugcugcuugagaaugaaaggacucuggacuuccacgauaguaacguuaagaauuuguaugagaaagugaaaagccagcucaagaacaaugccaaagagaucggaaacggcugcuucgaauuuuaccacaagugugacaaugagugcauggaauccguccggaacgggacauaugauuaccccaaauauucugaggagagcaagcugaaucgugaaaaaguggacggaguaaaguuagagucaauggguauuuaccagauccuggcaauuuauaguaccguugccuccagccuagugcuccuggucucucuuggcgcuauaucauucuggaugugcaguaacgggagcuugcaaugucgcaucugcauuuga

SEQ ID NO: 128591 - RNA, 1698 nt, Artificial Sequence
  derived and/or modified sequence opt3 from hemagglutinin__InfluenzaA__ADY00009
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaagaaaggauccuauccuaagcuggaaaacucauacgucaauaaaaagggcaaagaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucuccagaggcuucgggucaggaaucauaacuagcaacgccaguaugcacgaauguaauaccaagugccagacaccucugggcgcaauuaacucuuccuuaccauaccagaauauccaucccgugacuauuggugaguguccuaaauaugucaggagcgcuaagcugcggaugguuaccgggcuccgcaacaucccaucgauccagucucgaggacuuuuuggcgccauugcgggcuucauagaagggggauggacagguaugaucgacggcugguacggguaucaccaucaaaaugagcagggauccggcuacgccgcagaucagaaaucaacccagaacgcuauuaaugguaucacgaacaaggugaacacuguaauagagaaaaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggacuuccacgauaguaauguuaagaacuuguaugaaaaagucaagagccagcucaagaauaacgccaaagagaucggaaauggcugcuucgaguuuuaccacaagugugacaacgaaugcauggaguccgugcggaaugggacauaugauuaccccaaauauucugaagagagcaagcugaaccgugagaaaguggacggaguaaaguuagaaucaauggguauuuaccagauccuggcaauuuauaguaccguugccuccagccuagugcuccuggucucucuuggcgcuauaucauucuggaugugcaguaaugggagcuugcaaugucgcaucugcauuuga

SEQ ID NO: 128592 - RNA, 1698 nt, Artificial Sequence; identical to SEQ ID NO: 125294
  derived and/or modified sequence opt3 from hemagglutinin__InfluenzaA__ADY00020

SEQ ID NO: 128593 - RNA, 1698 nt, Artificial Sequence
  derived and/or modified sequence opt3 from hemagglutinin__InfluenzaA__ADY04727
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuucaucuuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccaaugggaacuugauugcuccgugguaugccuucgcgcucucucgcggauuuggcuccgguaucauaaccagcaaugcacccaugggggagugugaugccaagugccagacaccucaaggagcuauuaacucgucucugccauuccagaauguucaccccgugaccaucggcgaauguccuaaguacguaagauccgccaaauuaaggauggugacgggccugcggaacauuccaucaauccagagucgcgggcucuuuggagcaaucgcugguuucauugagggcggguggacuggaauggucgacggcugguaugguuaccaucaccagaaugaacaagggagcggcuacgccgcggaucagaaguccacacagaacgccauaaauggaaucaccaacaaagugaauagcguuauugagaagaugaacacucaguuuacagcagugggcaaagaguucaauaagcuagaacgaagaauggagaaccugaacaaaaaggucgacgauggguucuuggacaucuggaccuauaaugcugaacuacuggugcuccuggagaacgaaaggacgcuugauuuucacgacagcaaucugaagaacuuguacgagaaaguaaagucacaacucaaaaauaacgccaaggaaauaggaaaugguugcuucgaguuuuaucauaaauguaacaaugagugcauggaaaguguuaagaacggcaccuacgacuaucccaaguacuccgaggaaagcaaacugaaucgggagaagauugauggggugaaauuagagucuaugggagucuaucagauccuggcuaucuacucaacaguggccaguagccuaguccuccuggugucccuuggcgcaauuucuuucuggaugugcucgaacgguagcuugcagugucguaucugcauuuga

SEQ ID NO: 128594 - RNA, 1701 nt, Artificial Sequence; identical to SEQ ID NO: 125629
  derived and/or modified sequence opt3 from hemagglutinin__InfluenzaA__ADY11836

SEQ ID NO: 128595 - RNA, 1701 nt, Artificial Sequence; identical to SEQ ID NO: 125604
  derived and/or modified sequence opt3 from hemagglutinin__InfluenzaA__ADY17654

SEQ ID NO: 128596 - RNA, 1701 nt, Artificial Sequence
  derived and/or modified sequence opt3 from hemagglutinin__InfluenzaA__ADY17665
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacaggugagaucugcgacagcccacaccagauacuagauggcaaaaauuguacccucaucgacgcucugcuuggggauccgcagugcgacggauuucaaaacaagaaaugggaucuguucguagaaagauccaaggccuauucuaauuguuaccccuaugacgugccugauuacgcaucguugaggucacucgucgccagcaguggcacucuggaguuuaacaaugaauccuucaacuggacaggugugacccaggacgggacgucuagcgcuugcauucggcgcuccaaaaauucauuuuucagucgacugaacuggcucacucauuuaaauuuuaaauauccagcacugaacguuaccaugcccaauaacgagcaguucgauaagcuguacaucuggggagugcaccauccuggcacagacaaagaucagauuuuucuuuaugcccaagcuagcggccguaucacugucucuaccaagagaucccagcagacagccauaccaaacauugggucaaggccccgggugcgcaauaucccuagcagaauuaguaucuacuggaccaucguaaaaccaggagacauucugcuaauaaacucuacggguaaucucaucgcgccgaggggcuacuucaagauucgguccggaaagagcucgaucaugcgcucugacgcacccauagggaaauguaacuccgagugcauuacuccuaauggcucaaucccaaacgauaagcccuuucagaauguuaaccgaaucacauauggugccuguccuagauacgugaaacaaaauacccugaaguuggcuacugggaugaggaacgucccagaaaaacagacacggggaauuuucggcgccaucgcaggcuuuauugagaaugggugggaaggaaugguggacgguugguauggcuuccgucaccagaacagugaggggcgcggacaagcugccgaucuuaagagcacccaggcggccauagaccagaucaauggcaaauugaacagacucauugguaagacgaaugagaaguuccaccagaucgaaaaagaguuuuccgaaguggaggggaggauccaagaucuggaaaaguacgucgaggacaccaaaauugauuuauggucuuauaacgcagagcugcucguugcucuugaaaaccagcauacaauagaccugacugauagcgagaugaauaaguuguucgaaaagaccaagaagcagcuacgggagaacgccgaagacaugggcaauggaugcuuuaaaaucuaccacaagugugauaacgcuugcauuggcucaauccgaaaugggacauaugaccaugacguguaccgcgaugaggcccugaacaauagauuccagauuaaaggaguagagcucaagagugguuacaaagacuggauccuguggauauccuuugcaaucagcugcuuccuucuguguguggccuugcucggcuuuauuaugugggcuugccaaaaggggaacaucagguguaauauuugcaucuga

SEQ ID NO: 128597 - RNA, 1701 nt, Artificial Sequence; identical to SEQ ID NO: 125629
  derived and/or modified sequence opt3 from hemagglutinin__InfluenzaA__ADY17676

SEQ ID NO: 128598 - RNA, 1701 nt, Artificial Sequence
  derived and/or modified sequence opt3 from hemagglutinin__InfluenzaA__ADY17687
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggcgcuccaagaauagcuuuuucagucgacugaacuggcucacucauuuaaauuuuaaauauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcagacagccaucccaaacauagggucaaggccccggguacgcaauauuccuagcagaaucaguauuuacuggaccaucguuaaaccaggagacauccugcuaauuaacucuacggguaaucucauagcgccgaggggcuacuucaagauccgguccgggaagucaucgauuaugcgcucugacgcacccaucggaaaauguaacuccgagugcauaacuccuaauggcucaauuccaaacgauaagcccuuucagaaugugaaccgaaucacauauggugccuguccuagauacgucaaacaaaauacccugaaacuugcuacugggaugaggaacgugccagaaaaacagacacggggaaucuucggcgccauugcaggcuuuaucgagaaugggugggaaggaaugguggacgguugguauggcuuccgucaccagaacagugaggggcgcggacaagcugccgaucuuaagagcacccaggcggccauugaccagauaaauggcaaauugaacagacucaucgguaagacgaaugagaaguuccaccagauugaaaaagaguuuuccgaagucgaggggaggauccaagaucuggaaaaguacguugaggacaccaaaaucgauuuauggucuuauaacgcagagcugcucguggcucuugaaaaccagcauacaauugaccugacugauagcgagaugaauaaguuguucgaaaagaccaagaagcagcuacgggagaacgccgaagacaugggcaauggaugcuuuaaaauauaccacaagugugauaacgcuugcaucggcucaauucgaaaugggacauaugaccaugacguauaccgcgaugaggcccugaacaauagauuccagaucaaaggaguggagcucaagagugguuacaaagacuggauucuguggaucuccuuugcaauaagcugcuuccuucugugugccgcuuugcucggcuuuaucaugugggcgugccaaaaggggaacauuagguguaauaucugcauuuga

SEQ ID NO: 128599 - RNA, 1701 nt, Artificial Sequence; identical to SEQ ID NO: 125604
  derived and/or modified sequence opt3 from hemagglutinin__InfluenzaA__ADY17698

SEQ ID NO: 128600 - RNA, 1701 nt, Artificial Sequence
  derived and/or modified sequence opt3 from hemagglutinin__InfluenzaA__ADY38719
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcaaaaauuguacucucauagacgcgcugcuuggggauccgcagugcgacggauuucaaaacaagaaaugggaucuguucguggaaagauccaaggcuuauucuaauuguuaccccuaugacgucccugauuacgccucguugaggucacucguggcaagcaguggcacacuggaguuuaacaaugaauccuucaacuggaccgguguuacgcagaaugggacuucuagcgccugcauccggcgcuccaagaacucauuuuucagucgacugaauuggcucacccauuuaaacuuuaaauauccagcucugaaugugacaaugcccaacaacgagcaguucgacaagcuguacauuuggggaguccaccauccuggcacugauaaagaccagaucuuuuuguaugcacaagccagcggccguauuaccgugucuacaaagagaucccagcagaccgcuaucccaaauauagggucaaggccccggguacgcaacauuccuagcagaaucaguauuuacuggacgaucguuaaaccaggagauauccugcuaauuaauucuacugguaaccucauagccccgaggggcuacuucaagauccgguccggaaagagcucgauuaugcgcucugacgcgcccaucgggaaauguaauuccgagugcauaacaccuaacggcucaauuccaaaugacaagcccuuucagaacgugaaucgaaucaccuauggugcauguccuagauacgucaaacaaaacacucugaaacuugccacagggaugaggaaugugccagaaaaacagacccggggaaucuucggcgcuauugccggcuuuaucgagaacgggugggaaggaaugguggaugguugguauggcuuccgucaccagaauagugaggggcgcggacaagcagcugaccuuaagagcacgcaggccgcgauugaucagauaaacggcaaauugaauagacucaucgguaagaccaacgagaaguuccaccagauugaaaaagaguuuuccgaagucgaggggaggauccaagaccuggaaaaguacguugaggauacaaaaaucgacuuauggucuuauaacgccgagcugcucguggcacuugaaaaucagcauacuauugaucugaccgacagcgagaugaacaaguuguucgaaaagacaaagaagcagcuacgggagaaugcugaagauaugggcaacggaugcuuuaaaauauaccacaagugugacaaugccugcaucggcucaauucgaaacgggacuuaugaucaugacguauaccgcgacgaggcucugaauaacagauuccagaucaaaggaguggagcucaagagugguuacaaagauuggauucuguggaucuccuuugccauaagcugcuuccuucugugugucgcauugcucggcuuuaucaugugggccugccaaaaggggaauauuagguguaacaucugcauuuga

SEQ ID NO: 128601 - RNA, 1701 nt, Artificial Sequence; identical to SEQ ID NO: 124685
  derived and/or modified sequence opt3 from hemagglutinin__InfluenzaA__ADY38750

SEQ ID NO: 128602 - RNA, 1701 nt, Artificial Sequence; identical to SEQ ID NO: 125849
  derived and/or modified sequence opt3 from hemagglutinin__InfluenzaA__ADY38760

SEQ ID NO: 128603 - RNA, 1701 nt, Artificial Sequence
  derived and/or modified sequence opt3 from hemagglutinin__InfluenzaA__ADZ04607
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggguguaucaaauccuggcuauuuacucuacagucgcgucaaguuuggugcucguugugagccugggagcaauauccuuuuggaugugcucuaacgguucguuacagugccggaucuguauuuga

SEQ ID NO: 128604 - RNA, 1698 nt, Artificial Sequence; identical to SEQ ID NO: 127979
  derived and/or modified sequence opt3 from hemagglutinin__InfluenzaA__ADZ05834

SEQ ID NO: 128605 - RNA, 1698 nt, Artificial Sequence
  derived and/or modified sequence opt3 from hemagglutinin__InfluenzaA__ADZ05845
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacggggaaaauucauuuuaucggaacuuacuguggcuuaccggaaagaauggcuuguaccccaaccugaguaagagcuaugcaaauaacaaagagaaggaaguucuaguacucuggggcgugcaccacccuccaaacauggccgaucagaaaacgcuguaccauacugagaaugcuuacgucucugugguguccucacacuauagccgcaaguucacccccgaaaucgcaaagcgaccuaaaguccgugaccaggaggggagaauaaacuacuauuggacacuucuggagccaggagauacuaucauuuuugaagccaaugguaacuugaucgcuccgagguacgccuucgcgcucagucggggcuuugggucuggaauuaucaauuccaacgcacccauggacaagugugaugccaaaugccagaccccucaaggcgcuauaaauagcucgcugccauuccagaacguucaucccgugacaauuggugaguguccuaaguauguacgcucugccaaauuaagaauggugaccgggcugaggaauaucccauccauucagucacggggacucuuuggcgcaaucgcuggcuucaucgaagggggauggacggguauggucgacggcugguacggguaucaccaccagaacgagcaaggaaguggcuacgccgcggaucagaaaagcacucagaaugccauuaacgguauaacaaauaaagugaacuccguuaucgaaaagaugaauacccaguuuacugcaguggggaaggaguucaacaaacuugagcgccgaauggaaaaccugaauaagaaagucgacgauggcuucauugacaucuggacauacaacgcugaguugcuagugcugcucgaaaaugagagaacccuggacuuucaugauucuaacguaaagaaucuuuaugaaaaaguuaagagccaacugaagaacaaugccaaagagauaggaaacggcugcuucgaguuuuaccacaaguguaaugacgaaugcauggagucagugaaaaacgggacguaugauuaccccaaguauagugaagaguccaaauugaauagggagaagauugacggagucaagcucgaaagcauggguguguaccagauccuggcuaucuauucuaccgucgccucaaguuuagugcugcuaguuagccucggcgcaauuuccuucuggaugugcucuaacgggucgcugcagugucggaucugcauuuga

SEQ ID NO: 128606 - RNA, 1701 nt, Artificial Sequence; identical to SEQ ID NO: 124450
  derived and/or modified sequence opt3 from hemagglutinin__InfluenzaA__ADZ05855

SEQ ID NO: 128607 - RNA, 1701 nt, Artificial Sequence
  derived and/or modified sequence opt3 from hemagglutinin__InfluenzaA__ADZ47838
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucgacuacgaagaacugagggagcagcugagcaguguguccucuuuugaacgguucgagauuuuuccgaagacaagcuccuggcccaaucacgauucaaacaagggugucaccgccgcuuguccucaugcaggggccaaaaguuucuauaagaaucucaucugguuagugaaaaagggaaacagcuacccaaaacugucuaaguccuauauaaaugacaagggcaaagaaguacuuguuuuguggggcauccaccaccccucaacgagcgcugaucaacagagucuguaccagaacgccgacgcguacguguuugucgggacuucucgcuauuccaagaaauucaagccugagauugcaauccgaccaaaagugcgugagcaggaaggaagaaugaauuacuauuggacccuaguggagcccggugauaagauuacauuugaagccacuggcaaccucgucguuccuagguacgcuuucgccauggagcggaacgcagggagcggaaucauaauuucggacaccccagugcaugauugcaauacaaccugucaaacgccgaaaggcgcuaucaacacuucucugcccuuucagaauauucacuccaucacaaucgguaagugcccuaaguauguaaaaucaaccaaacuucgccuggccacuggguugagaaacgugccaaguauucagagcaggggacucuucggcgcgauagccggcuuuaucgaagggggauggacagguauggucgacggcugguacggguaucaucaccagaaugagcaaggauccggcuacgcagcugaccugaaaucuacccagaacgccauugaugagaucacgaauaaggugaacagcguuauagagaaaaugaauacccaguucacagcuguggguaaggaguuuaaccacuuagaaaagcggauugagaaucugaacaaaaaggucgacgauggguuccucgacaucuggacuuacaaugccgaacuucugguguugcuagagaacgagcgcacccuggauuaucaugacucaaauguaaagaaccucuacgaaaagguucgaagucagcugaaaaacaaugcaaaggagaucggcaacggauguuucgaauuuuaucacaagugcgauaauacauguauggaguccgugaaaaacggcacuuacgacuaucccaaguacagcgaagaggccaaacuuaauagagaggaaauugauggggucaagcuggagucuaccaggaucuaucaaauuuuggcuauauacucaacaguggcgaguagcuucguccucaucgugucccugggagcaauuucuuuuuggaugugcucgaacgguagcuuacagugccggaucuguaucuga

SEQ ID NO: 128608 - RNA, 1701 nt, Artificial Sequence; identical to SEQ ID NO: 125857
  derived and/or modified sequence opt3 from hemagglutinin__InfluenzaA__ADZ47858

SEQ ID NO: 128609 - RNA, 1698 nt, Artificial Sequence
  derived and/or modified sequence opt3 from hemagglutinin__InfluenzaA__ADZ53100
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagaccuggagcuacaucguugaaaagccaaacccggagaauggaacuuguuaucccggccauuuugcugauuacgaggaacugagagagcaacucuccucugugucgucauucgaaagguuugagauuuucccuaaggagagcaguuggccaaaccacacagucaccgguguguccgccucuugcagccauaauggggaauccucauuuuaucggaacuuacuguggcuuacgggcaaaaauggauuguaccccaaccugaguaagagcuaugcaaauaacaaagagaaggaaguucuaguacucuggggcgugcaccacccuccaucuaucaacgaccagaaaacucuguaccauaccgagaaugccuacgucuccguggugucaagccacuauagucgcaaguucacacccgaaauagcuaagcgaccuaaaguccgugaucaggaggggagaaucaacuacuauuggacucuucuggagccaagggacaccauuaucuuugaagcaaauggaaacuugauugccccgcgguacgcuuucgcccucucucgcgguuuuggcuccgggaucauaaauagcaacgcgcccauggauaagugugacgcaaaaugccagacaccucaaggagccauuaauucgucucugccauuccagaacguucaucccgugaccaucggcgaguguccuaaguauguaagauccgcuaaauuaaggauggugacgggucugcggaauauuccaucaauccagagucgcgggcucuuuggagccaucgcaggcuucauugaaggcggguggacuggaauggucgaugguugguacggcuaucaccaccagaacgagcaagggagcggauacgcugccgaccagaaguccacacagaaugcgauaaacggcaucaccaauaaagugaacucuguuauugaaaagaugaauacucaguuuacagccguggguaaggaguucaacaaacuugagcgaagaauggaaaaccugaauaagaaagucgaugacggguucaucgauauauggaccuacaacgcagaguugcuagugcugcucgaaaaugagaggacgcuggacuuucaugacagcaacguaaagaaucuuuaugaaaaaguuaagucacaacugaagaacaaugcuaaagagauuggcaacggaugcuucgaguuuuaccacaaguguaaugaugaaugcauggagagugugaaaaacggcaccuaugacuaccccaaguauuccgaagagagcaaauugaaucgggagaagaucgauggggucaagcucgaaucuaugggaguguaccagauccuggccauuuauucaacagucgcuaguagcuuagugcugcuaguuucccucggugccaucucuuucuggaugugcucgaacggcagccugcagugucguauuugcauauga

SEQ ID NO: 128610 - RNA, 1701 nt, Artificial Sequence; identical to SEQ ID NO: 125132
  derived and/or modified sequence opt3 from hemagglutinin__InfluenzaA__ADZ53123

SEQ ID NO: 128611 - RNA, 1701 nt, Artificial Sequence; identical to SEQ ID NO: 124927
  derived and/or modified sequence opt3 from hemagglutinin__InfluenzaA__ADZ53125

SEQ ID NO: 128612 - RNA, 1701 nt, Artificial Sequence; identical to SEQ ID NO: 125309
  derived and/or modified sequence opt3 from hemagglutinin__InfluenzaA__ADZ53127

SEQ ID NO: 128613 - RNA, 1701 nt, Artificial Sequence; identical to SEQ ID NO: 124672
  derived and/or modified sequence opt3 from hemagglutinin__InfluenzaA__ADZ53131

SEQ ID NO: 128614 - RNA, 1701 nt, Artificial Sequence; identical to SEQ ID NO: 124685
  derived and/or modified sequence opt3 from hemagglutinin__InfluenzaA__ADZ53133

SEQ ID NO: 128615 - RNA, 1701 nt, Artificial Sequence; identical to SEQ ID NO: 124927
  derived and/or modified sequence opt3 from hemagglutinin__InfluenzaA__ADZ53135

SEQ ID NO: 128616 - RNA, 1701 nt, Artificial Sequence; identical to SEQ ID NO: 125849
  derived and/or modified sequence opt3 from hemagglutinin__InfluenzaA__ADZ53138

SEQ ID NO: 128617 - RNA, 1701 nt, Artificial Sequence; identical to SEQ ID NO: 124685
  derived and/or modified sequence opt3 from hemagglutinin__InfluenzaA__ADZ53140

SEQ ID NO: 128618 - RNA, 1701 nt, Artificial Sequence; identical to SEQ ID NO: 125132
  derived and/or modified sequence opt3 from hemagglutinin__InfluenzaA__ADZ93496

SEQ ID NO: 128619 - RNA, 1689 nt, Artificial Sequence; identical to SEQ ID NO: 124366
  derived and/or modified sequence opt3 from hemagglutinin__InfluenzaA__AEA04365

SEQ ID NO: 128620 - RNA, 1689 nt, Artificial Sequence
  derived and/or modified sequence opt3 from hemagglutinin__InfluenzaA__AEA04376
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaggaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacugagaagggcagcaacuauccuguggcaaaagggaguuacaauaacacauccggagagcagaugcuuaucauuugggguguccaccacccaaaugacgaaaccgagcagaggacguuguaucagaacgugggcacuuacguaucuguugggaccagcacacugaauaagcgguccacucccgaaaucgccacccgcccuaaggugaacggacaaggcgguagaauggaguuuucauggacacuacucgauaugugggacaccauaaacuucgaaaguacggggaaucugauugcuccagaguacggauuuaaaaucagcaagagggggucuuccggcauuaugaaaacugagggcacacuugaaaacugcgagaccaagugucagacuccgcugggagcaaucaauacaaccuugcccuuccauaacguccacccucucacgaucggugaaugcccaaaauaugugaagucagagaaacugguguuagccaccggccugcggaaugucccccagauugaaagccgcgggcucuuuggagcuauagccggcuucaucgaggguggguggcagggcaugguugauggaugguacggcuaucaucacaguaacgaccaagggucuggauacgcggcagauaaggaguccacacagaaggccuuugacgguauuacuaauaaagugaacagcguaaucgaaaagaugaauacccaguucgaggcugugggcaaagaauuuucgaaccuugagcgaagacuggaaaauuugaacaagaaagucgaggacggguuccuagauguguggacauauaaugccgagcugcucguucugauggaaaacgagaggacucuugacuuccacgauucuaaugugaagaaccuguacgacaagguccggaugcaguugcgugauaacgugaaagaacucggaaauggcuguuuugaguucuaucauaagugcgacgaugaguguaugaacuccguuaaaaaugguaccuacgacuacccuaaguaugaagaggaaucaaaacugaaccgcaaugagauaaaggggguaaaguuaaguagcaugggcguguaccaaauucuggcaaucuaugcuacagucgccggaucccuaucucucgcgaucaugauggccggcauuagcuuuuggaugugcucaaacgggagucugcagugcagaaucuguauuuga

SEQ ID NO: 128621 - RNA, 1698 nt, Artificial Sequence
  derived and/or modified sequence opt3 from hemagglutinin__InfluenzaA__AEA10292
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugcucacucaagggaauagcgccccugcagcuugguaacuguaguguggccggcuggauccuggggaauccugagugcgaauugcucauuagcaaagaguccuggucuuacaucguugaaaagccaaacccggagaauggaaccuguuaucccggccauuuugcugauuacgaggaacugagagagcaacugucgucagugagcaguuucgaaagguuugagauuuucccuaaggaguccucuuggccaaaccacacugucacaggugugagcgccuccugcucacauaauggggaaaguagcuuuuaucggaaccucuuauggcugaccguuaaaaauggacuuuaccccaacuugucuaaguccuaugcaaauaacaaagagaaggaaguacuggugcuauggggcguccaccacccuccaaacaucguggaccagaaaacgcucuaccgcacugagaaugccuacgugucagucguuagcagucauuauucucgaaaguucacccccgaaauagcuaagcguccuaaagugagagaucaggagggcaggaucaacuacuauuggacacugcuugagccaggggacacuauuaucuuugaagcaaauggaaaccugauugccccgcgguacgcuuucgccuugucccgcgguuuuggcagcgggaucauaaauucgaacgcgcccauggauaagugugacgcaaaaugccagaccccuagaggagccauuaauucuucccucccauuccaaaacguacaccccgugacaaucggcgaguguccuaaguaugucaggucagcuaaacugcggauggugaccgguuuacgcaauauuccaaguauccagagccgagggcuguuuggagccaucgcaggcuucauugaaggcggguggacgggaaugguugaugguugguacggcuaucaucaccagaacgagcagggguccggauacgcugccgaccaaaagucuacucagaaugcgauaaacggcaucacaaauaaagugaacagcgucauugaaaagaugaauacccaguuuacugccguggguaaggaguucaacaaacucgagagaaggauggaaaaccuuaauaagaaaguagaugacggguucaucgauauauggacauacaacgcagagcuguugguucuacuggaaaaugagcggacccucgacuuucacgacucaaacgugaagaaucuguaugaaaaagucaagagucagcuuaagaacaaugcuaaagagauuggcaacggaugcuucgaguuuuaccauaaguguaaugaugaaugcauggaguccgugaaaaacggcacguaugacuaccccaaguauagcgaagagucuaaacugaaucgugagaagaucgauggggucaaguuggaaucaaugggaguguaccaaauccucgccauuuauaguaccguugcuagcucccugguguuacugguaucucuaggugccaucucguucuggaugugcagcaacggcucccuccagugucgcauuugcauauga

SEQ ID NO: 128622 - RNA, 1701 nt, Artificial Sequence; identical to SEQ ID NO: 127284
  derived and/or modified sequence opt3 from hemagglutinin__InfluenzaA__AEA10303

SEQ ID NO: 128623 - RNA, 1701 nt, Artificial Sequence; identical to SEQ ID NO: 128138
  derived and/or modified sequence opt3 from hemagglutinin__InfluenzaA__AEA10313

SEQ ID NO: 128624 - RNA, 1701 nt, Artificial Sequence; identical to SEQ ID NO: 125849
  derived and/or modified sequence opt3 from hemagglutinin__InfluenzaA__AEA10323

SEQ ID NO: 128625 - RNA, 1701 nt, Artificial Sequence; identical to SEQ ID NO: 126237
  derived and/or modified sequence opt3 from hemagglutinin__InfluenzaA__AEA10339

SEQ ID NO: 128626 - RNA, 1701 nt, Artificial Sequence
  derived and/or modified sequence opt3 from hemagglutinin__InfluenzaA__AEA10349
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 128627 - RNA, 1701 nt, Artificial Sequence; identical to SEQ ID NO: 126282
  derived and/or modified sequence opt3 from hemagglutinin__InfluenzaA__AEA30293

SEQ ID NO: 128628 - RNA, 1701 nt, Artificial Sequence
  derived and/or modified sequence opt3 from hemagglutinin__InfluenzaA__AEA48989
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggcccgcaguuuuuauaaaaaucugaucuggcucgugaagaaaggaaacagcuacccaaaguuaucuaaauccuauauaaaugauaagggcaaggagguacugguucuuuggggcauccaccaccccucaacgagcgcugaccaacagaguuuguaccagaacgccgaugcguacguguucgucgggacuucucgauauuccaaaaaguuuaaaccugagauugcaauccguccaaaggugagagaccaggaaggaaggaugaauuacuauuggacccugguggagcccggugauaaaauuacauucgaagccacuggcaaccuagucguuccucgguacgcuuuugccauggagcgcaacgcagggagcggaaucauaauuucggacaccccagugcaugauugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugagcaaggaagcggcuacgcagcugaccucaaguccacccagaacgccauugaugagaucacgaauaaagugaacucuguuauagaaaagaugaauacccaguuuacagcuguggguaaagaguucaaccaccuggaaaagcgcauugagaauuuaaacaagaaagucgacgauggguuccuggacaucuggacuuacaaugccgaacuccuugugcuguuggagaacgagcgaacccuagauuaucaugacagcaauguaaagaaccuguacgaaaaaguuagaucacagcucaagaacaaugcaaaagagaucggcaacggauguuuugaguucuaucacaagugcgauaauacauguauggagagugugaagaacggcacuuacgacuauccuaaauacuccgaagaggccaagcugaauagggaggaaauugauggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 128629 - RNA, 1707 nt, Artificial Sequence
  derived and/or modified sequence opt3 from hemagglutinin__InfluenzaA__AEA50985
auggagaagaucgugcugcuccuugccauuauaaaccuggucaaaagcgaccagaucugcauuggcuaccacgcuaauaacuccaccgaacaaguugauacaaucauggagaagaaugugacuguaacgcaugcacaggacauuuuggaaaagacccacaacgggaaauuaugugaucuggacggagugaaaccccuaauccucagagauugcucugucgccgguuggcugcuuggcaauccuaugugugacgaguuccugaacgugccagaauggucauauauaguugagaagaucaauccggcgaacgauuugugcuaccccgggaauuuuaacgacuaugaggaacucaagcaucugcugaguaggauuaaucacuucgagaaaauccagauuaucccuaagagcuccuggucugaucaugaggcuucgucaggagugagcagugccuguccauaccagggccgguccuccuuuuuccgcaacgucguguggcucauuaaaaagaaugacgcauaucccacaauaaaaaucagcuacaacaauacuaaccaagaagauuuacugguacuuugggguauucaccacccuaacgacgccgcugagcagaccaaguuguaucagaauccaacaaccuacaucuccguugggacuucaacacugaaccuacgacucgugcccaagaucgcaacccguaguaaagucaauggacagagcggcagaauggaauuuuucuggacgauucugaagccuaacgaugccauaaauuuugagucuaacggcaauuucaucgcuccagaaaacgccuacaaaauugugaagaaaggggacuccacuaucaugaagucagagcuugaauauggaaauugcaacaccaaaugucaaacaccggugggugcgauaaauagcaguaugcccuuucauaacauucacccucugacuaucggcgagugcccaaaguacgucaagucuaauagguugguucucgcaaccgggcugcggaacucuccccagggagagcgcagaaggaaaaagcggggcuuauucggugccaucgcuggguuuauugaaggaggcuggcagggcaugguggacgggugguauggauaccaucacagcaaugagcaggguucgggcuaugccgcagauaaagaaucuacacaaaaggcuaucaacgggguaaccaacaaagucaauuccauuauagacaagaugaacacgcaguucgaggccgugggacgcgaauuuaauaaccuggagcgaagaaucgagaaucucaacaagaaaauggaagauggcuuccuugacguguggacuuacaaugcggagcuguugguucuaauggaaaacgagaggacacuggauuuccacgacucaaaugugaagaaccucuaugauaaaguccggcugcagcuucgugacaaugccaaggaacuggguaacggguguuuugaguucuaccaucgcugcgauaaugaguguauggaaagugugagaaacggcaccuacgacuauccucaauacagcgaggaauccagguugaaacgggaggagauuucuggaguaaagcucgaaagcaucggcaucuaucagauucugucaauauacaguacugcagcuuccagcuuagcccuggcuaucaugguugccgggcuaucucucuggaugugcucaaauggaagucugcagugccgaauuuguaucuga

SEQ ID NO: 128630 - RNA, 1701 nt, Artificial Sequence; identical to SEQ ID NO: 127549
  derived and/or modified sequence opt3 from hemagglutinin__InfluenzaA__AEA72704

SEQ ID NO: 128631 - RNA, 1701 nt, Artificial Sequence; identical to SEQ ID NO: 127549
  derived and/or modified sequence opt3 from hemagglutinin__InfluenzaA__AEA72715

SEQ ID NO: 128632 - RNA, 1701 nt, Artificial Sequence; identical to SEQ ID NO: 127549
  derived and/or modified sequence opt3 from hemagglutinin__InfluenzaA__AEA72726

SEQ ID NO: 128633 - RNA, 1701 nt, Artificial Sequence
  derived and/or modified sequence opt3 from hemagglutinin__InfluenzaA__AEA72740
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaacccgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaaaccagcucaaaaauaacgcaaaggaaaucggcaauggauguuuugaguucuaucacaagugcgacaacacuuguauggaaucagugaaaaauggcaccuacgauuauccuaaguacagugaggaagccaaacugaacagagaggagaucgacggggucaaacuugaauccacaaggauuuaucaaauccuggcuauuuacagcaccguggcgucuucauugguccucgugguuagucugggagcaaucagcuuuuggaugugcuccaaugguucuuuacagugccggauauguauuuga

SEQ ID NO: 128634 - RNA, 1701 nt, Artificial Sequence
  derived and/or modified sequence opt3 from hemagglutinin__InfluenzaA__AEA72750
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgauaccuacgucuucguggggacaagucgcuauucuaagaaauuuaagccugagauugcgauccgaccaaaagugcgugaccaggagggaagaaugaauuacuauuggacucuggucgaacccggugauaagauuaccuucgaggcaacaggcaaccuaguugugccuagguacgccuuugcuauggaacggaacgccggguccggaaucauaauuagcgacaccccaguacaugauugcaauacgacuugucaaacaccgaaaggcgcaaucaacaccucgcuccccuuccagaauauucacccuaucacuaucgguaagugcccaaaguaugugaaaucuacaaagcugcgccuugcuaccgggcugagaaacguccccuccauucagucaaggggauuguuuggcgccauagcgggcuucaucgaagggggauggacggguaugguggacggcugguacggguaucaucaccagaaugaacaaggaaguggcuacgccgcagaccucaaaagcacccagaacgcuauugauaagaucacaaauaaaguuaacuccgugauagagaagaugaauacucaguuuaccgccgucgguaaggaguucaaccaccuggaaaaacggauugagaauuuaaacaagaaaguggacgauggguuccuggacaucuggacauacaaugcugaacuccuuguacuguuggagaacgaacgcacucuagauuaucaugacucuaauguuaagaaccuguacgagaaagugcgaaaccagcucaagaauaacgccaaggagaucggcaauggauguuuugaguucuaucacaaaugcgauaacaccuguauggaaagcgucaagaauggcacauacgacuauccuaaauacucagaagaggcaaagcugaacagagaagagauugauggggugaaacuugagaguaccaggaucuaucaaauucuggccauauacuccacugucgcuagcucuuuggugcucguugugucacugggagcgaucaguuuuuggaugugcagcaaugguuccuuacagugccggauuuguaucuga

SEQ ID NO: 128635 - RNA, 1701 nt, Artificial Sequence; identical to SEQ ID NO: 128451
  derived and/or modified sequence opt3 from hemagglutinin__InfluenzaA__AEA72759

SEQ ID NO: 128636 - RNA, 1701 nt, Artificial Sequence
  derived and/or modified sequence opt3 from hemagglutinin__InfluenzaA__AEA72777
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacgacgggaaacucuguaagcugagaggaguggcuccccuucaucuggguaaaugcaauauagccggcuggaucuuggggaacccugagugugaaucucucucaacagcaaguagcugguccuacauuguugagaccucuucgucagauaauggaacuugcuauccaggcgacuucaucgauuacgaggagcugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucuaaguccuauauaaacgauaagggcaaagaaauccuuguauuguggggcauucaccaccccucaacgagcgcugaccaacagagucuguaccagaaugccgaugcguacguuuuuguggggacuucucgcuauuccaagaaauucaagccugagaucgcaauucgaccaaaaguccgugaccaggagggaagaaugaacuacuauuggacccuaguggaacccggugauaagaucacauuugaggccacuggcaaucucguggucccuagguacgcuuucgccauggaacggaacgcagggagcggaauaauuaucucggacaccccaguucaugacugcaacgcuacaugucaaaccccgaaaggcgccauuaauacgucucugcccuuucagaacauccacccuaucacuauugguaagugcccaaaguaugugaaauccacaaaacuucgccuggcgaccggguugagaaauguacccucaauacagaguaggggacucuucggcgccaucgcaggcuuuauugaagggggauggacugguaugguggauggcugguacggguaucaucaccagaacgaacaaggaagcggcuacgcugccgaccugaaguccacacagaaugcuaucgauaagauaaccaacaaagucaauucugugauugagaagaugaacacgcaguucaccgccguugguaaggaguuuaaucacuuagaaaaacggaucgagaaccugaauaagaaaguggacgauggguuccucgacaucuggacauacaacgcagaacuucuggucuugcuagagaaugaacgcacucuggauuaucaugacagcaacgugaagaaucucuacgagaaaguacgaucacagcugaagaacaacgccaaggagauuggcaauggauguuucgaauuuuaucacaaaugcgauaacaccuguauggagaguguuaagaauggcacauacgacuauccuaaauacuccgaagaggcuaaacuuaacagagaagagaucgauggggugaagcuggagagcacuaggauuuaucaaauauuggcgaucuacucuaccgucgcaucaagucucgugcuggucgugagcuuaggagccauuuccuucuggaugugcucuaaugguucgcugcagugccggaucuguaucuga

SEQ ID NO: 128637 - RNA, 1701 nt, Artificial Sequence; identical to SEQ ID NO: 128451
  derived and/or modified sequence opt3 from hemagglutinin__InfluenzaA__AEA72787

SEQ ID NO: 128638 - RNA, 1701 nt, Artificial Sequence; identical to SEQ ID NO: 127549
  derived and/or modified sequence opt3 from hemagglutinin__InfluenzaA__AEA73288

SEQ ID NO: 128639 - RNA, 1701 nt, Artificial Sequence; identical to SEQ ID NO: 127549
  derived and/or modified sequence opt3 from hemagglutinin__InfluenzaA__AEA73299

SEQ ID NO: 128640 - RNA, 1701 nt, Artificial Sequence; identical to SEQ ID NO: 127549
  derived and/or modified sequence opt3 from hemagglutinin__InfluenzaA__AEA73310

SEQ ID NO: 128641 - RNA, 1701 nt, Artificial Sequence
  derived and/or modified sequence opt3 from hemagglutinin__InfluenzaA__AEA73321
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaguacacugaaacuugcuaccgggaugaggaaugugccagagaagcagacucggggaaucuucggcgccauugcaggcuuuaucgaaaacgggugggagggaauggucgaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguugaagggaggauccaagaccuggagaaguacguggaggauacgaaaaucgacuuauggagcuauaacgcagaacugcucguaacccuugagaaucagcauacaauugaucugacugacucagaaaugaacaaguuguucgagaaaaccaagaaacagcuacgggaaaaugcugaggauaugggcaacggaugcuuuacaauauaccacaagugugacaaugccugcaucggcaguauucgaaacgggacuuaugaucauaauguguaccgcgacgaggcucugaacaauagauuccagaucaagggagucgaacucaaauccgguuacaaggacuggauucuguggaucagcuuugccauaucuugcuuccuucuguguguggcauugcucggcuuuaucaugugggccugccaaaaagggaacauuagguguaauaucugcauuuga

SEQ ID NO: 128642 - RNA, 1701 nt, Artificial Sequence; identical to SEQ ID NO: 127549
  derived and/or modified sequence opt3 from hemagglutinin__InfluenzaA__AEA73332

SEQ ID NO: 128643 - RNA, 1701 nt, Artificial Sequence; identical to SEQ ID NO: 127549
  derived and/or modified sequence opt3 from hemagglutinin__InfluenzaA__AEA73343

SEQ ID NO: 128644 - RNA, 1701 nt, Artificial Sequence; identical to SEQ ID NO: 127549
  derived and/or modified sequence opt3 from hemagglutinin__InfluenzaA__AEA73354

SEQ ID NO: 128645 - RNA, 1701 nt, Artificial Sequence
  derived and/or modified sequence opt3 from hemagglutinin__InfluenzaA__AEA73365
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccggugagaucugcgacagcccacaccagauucuagauggcgaaaauuguacucucaucgacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacacuggaauuuaacaaugaguccuucaacuggaccgguguuacgcagaaugggacuucuagcgcuugcauacggcgcuccaacaauucauuuuucagucgacugaacuggcucacccauuuaaauuuuaaguauccagcacugaacgugacaaugcccaacaaugagcaguucgacaaguuguacaucuggggaguccaccauccuggcacugauaaagaccagauuuuucuuuaugcccaagcuagcggccguaucaccgugucuacaaagagaucccagcaggccguaauuccaaacaucgggucaaggccccggguucgcaauauaccuagcagaauuaguaucuacuggaccauugugaaaccaggagauauccugcuaaucaacucuacggguaaucucauugcgccgaggggcuacuucaagauacgguccgggaaaagcucgaucaugcgcucugacgcacccauuggaaaguguaacuccgaaugcaucacuccuaauggcucaauaccaaacgacaagcccuuucagaaugucaaccgaauuacauauggugccuguccuagauacgugaaacaaaguacccugaaacuugcuacugggaugaggaaugugccagagaagcagacacggggaaucuucggcgccaucgcaggcuuuauugaaaacgggugggagggaauggucgaugguugguauggcuuccgucaccagaauagcgaggggcgcggacaagcugccgaccugaaguccacccaggcggccaucgaucagauuaacggcaaauugaauagacucauagguaagacgaacgaaaaauuccaccagaucgagaaggaauuuucugagguugaagggaggauucaagaccuggagaaguacguggaggauaccaaaaucgacuuauggagcuauaacgcagaacugcucguagcucuugagaaucagcauacaaucgaucugacugacucagaaaugaacaaguuguucgagaaaaccaagaaacagcuacgggaaaaugccgaggauaugggcaacggaugcuuuacaauuuaccacaagugugacaaugcuugcauaggcaguauccgaaacgggacuuaugaucauaauguguaccgcgacgaggcccugaacaauagauuccagauuaagggagucgaacucaaauccgguuacaaggacuggauccuguggauuagcuuugcaaucucuugcuuccuucuguguguggccuugcucggcuuuauaaugugggcuugccaaaaagggaacaucagguguaauauuugcaucuga

SEQ ID NO: 128646 - RNA, 1701 nt, Artificial Sequence; identical to SEQ ID NO: 127549
  derived and/or modified sequence opt3 from hemagglutinin__InfluenzaA__AEA73376

SEQ ID NO: 128647 - RNA, 1701 nt, Artificial Sequence; identical to SEQ ID NO: 127549
  derived and/or modified sequence opt3 from hemagglutinin__InfluenzaA__AEA73387

SEQ ID NO: 128648 - RNA, 1701 nt, Artificial Sequence; identical to SEQ ID NO: 127549
  derived and/or modified sequence opt3 from hemagglutinin__InfluenzaA__AEA73398

SEQ ID NO: 128649 - RNA, 1701 nt, Artificial Sequence; identical to SEQ ID NO: 127549
  derived and/or modified sequence opt3 from hemagglutinin__InfluenzaA__AEA73409

SEQ ID NO: 128650 - RNA, 1701 nt, Artificial Sequence; identical to SEQ ID NO: 127549
  derived and/or modified sequence opt3 from hemagglutinin__InfluenzaA__AEA73420

SEQ ID NO: 128651 - RNA, 1701 nt, Artificial Sequence; identical to SEQ ID NO: 127549
  derived and/or modified sequence opt3 from hemagglutinin__InfluenzaA__AEA73452

SEQ ID NO: 128652 - RNA, 1701 nt, Artificial Sequence; identical to SEQ ID NO: 127549
  derived and/or modified sequence opt3 from hemagglutinin__InfluenzaA__AEA73463

SEQ ID NO: 128653 - RNA, 1701 nt, Artificial Sequence; identical to SEQ ID NO: 127549
  derived and/or modified sequence opt3 from hemagglutinin__InfluenzaA__AEA73474

SEQ ID NO: 128654 - RNA, 1701 nt, Artificial Sequence
  derived and/or modified sequence opt3 from hemagglutinin__InfluenzaA__AEA73485
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagaaucaguauuuauuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuacggugccuguccuagauaugugaaacaaaguacacugaaacuugcuaccgggaugaggaaugugccagagaagcagacucggggaaucuucggcgccauugcaggcuuuaucgaaaacgggugggagggaauggucgaugguugguacggcuuccgucaccagaauagcgaggggcgcggacaagcugccgaccugaaguccacacaggcggccauugaucagauaaacggcaaauugaauagacucaucgguaagaccaacgaaaaauuccaucagauugagaaggaauuuucugagguugaagggaggauccaagaccuggagaaguauguggaggauacgaaaaucgacuuauggagcuacaacgcagaacugcucguagcucuugagaaucagcacaccauugaucugacagacucagaaaugaacaaguuguucgagaaaacuaagaaacagcuacgggaaaaugccgaggauaugggcaacggaugcuuuaccauauaucauaagugugacaaugcuugcaucggcaguauucgaaacgggacauacgaucacaauguguaucgcgacgaggcccugaacaauagauuccagaucaagggagucgaacucaaauccgguuacaaggacuggauucuguggaucagcuuugcaauaucuugcuuccuucuguguguggccuugcucggcuuuaucaugugggcuugccaaaaagggaacauuagguguaauaucugcauuuga

SEQ ID NO: 128655 - RNA, 1701 nt, Artificial Sequence; identical to SEQ ID NO: 127549
  derived and/or modified sequence opt3 from hemagglutinin__InfluenzaA__AEA73496

SEQ ID NO: 128656 - RNA, 1701 nt, Artificial Sequence; identical to SEQ ID NO: 127549
  derived and/or modified sequence opt3 from hemagglutinin__InfluenzaA__AEA73507

SEQ ID NO: 128657 - RNA, 1701 nt, Artificial Sequence; identical to SEQ ID NO: 127549
  derived and/or modified sequence opt3 from hemagglutinin__InfluenzaA__AEA73518

SEQ ID NO: 128658 - RNA, 1701 nt, Artificial Sequence; identical to SEQ ID NO: 127549
  derived and/or modified sequence opt3 from hemagglutinin__InfluenzaA__AEA73529

SEQ ID NO: 128659 - RNA, 1701 nt, Artificial Sequence; identical to SEQ ID NO: 127549
  derived and/or modified sequence opt3 from hemagglutinin__InfluenzaA__AEA73540

SEQ ID NO: 128660 - RNA, 1701 nt, Artificial Sequence; identical to SEQ ID NO: 127549
  derived and/or modified sequence opt3 from hemagglutinin__InfluenzaA__AEA73551

SEQ ID NO: 128661 - RNA, 1701 nt, Artificial Sequence; identical to SEQ ID NO: 127549
  derived and/or modified sequence opt3 from hemagglutinin__InfluenzaA__AEA73562

SEQ ID NO: 128662 - RNA, 1698 nt, Artificial Sequence
  derived and/or modified sequence opt3 from hemagglutinin__InfluenzaA__AEA73573
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggagguucuaguacucuggggcgugcaccacccuccaaacaucggcgaccagaaaacgcuguaccauacugaaaaugccuacgucuccguggugucaagccacuauagucgcaaguucacccccgagauagcuaagcgaccuaaaguccgugaucaggaggggagaaucaacuacuauuggacacuucuggaaccaggagacacuauuaucuuugaggcaaaugguaacuugauugccccgagguacgcuuucgcccucucucggggcuuuggguccggaaucauaaauagcaacgcgcccauggauaagugugacgcaaaaugccagaccccucaaggcgccauuaauucgucucugccauuccagaacguucaucccgugacaaucggugaauguccuaaguauguacgcuccgcuaaauuaagaauggugaccgggcugaggaauauuccaucaauccagagucggggacucuuuggcgccaucgcaggcuucauugaagggggauggacggguauggucgauggcugguacggguaucaccaccagaacgagcaaggaagcggcuacgcugccgaccagaaguccacucagaaugcgauaaacgguaucacaaauaaagugaacucuguuauugagaagaugaauacccaguuuacugccguggggaaggaguucaacaaacuugaacgccgaauggagaaccugaauaagaaagucgaugacggcuucaucgauauauggacauacaacgcagaauugcuagugcugcucgagaaugaaagaacccuggacuuucaugacagcaacguaaagaaucuuuaugagaaaguuaagucacaacugaagaacaaugcuaaagagauuggaaacggcugcuucgaauuuuaccacaaguguaaugaugagugcauggaaagugugaaaaacgggacguaugacuaccccaaguauuccgaggagagcaaauugaauagggaaaagaucgauggagucaagcucgagucuauggguguguaccagauccuggccauuuauucaaccgucgcuaguagcuuagugcugcuaguuucccucggcgccaucucuuucuggaugugcucgaacgggagccugcagugucggauuugcauauga

SEQ ID NO: 128663 - RNA, 1698 nt, Artificial Sequence
  derived and/or modified sequence opt3 from hemagglutinin__InfluenzaA__AEA73584
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagaaaccaggaggggaggaucaauuacuauuggacacuucuggagccaggagauacuauuaucuuugaagcaaacgguaauuugauugccccgcgguacgcuuucgcccucucucgcggcuuuggguccggaaucauaaacagcaaugcgcccauggacaagugugaugcaaaaugccagaccccucaaggcgccauuaacucgucucugccauuccagaaugugcaccccguaacaaucggugaguguccuaaguaugugagauccgcuaaauuaaggauggucaccgggcugcggaacauuccaucaauccagagucgcggacucuuuggcgccaucgcaggcuucauugaagggggauggacggguaugguggacggcugguacggguaucaucaccagaaugagcaaggaagcggcuacgcugccgaucagaaguccacucagaacgcgauaaaugguaucacaaacaaaguuaauucugugauugaaaagaugaacacccaguuuacugccgucgggaaggaguucaacaaacuugagcgaagaauggaaaaucugaacaagaaaguggacgauggcuucaucgacauauggacauacaaugcagaguugcuaguacugcucgaaaacgagaggacccuggauuuucacgacagcaauguuaagaaccuuuaugaaaaagugaagucacaacugaagaauaacgcuaaagagauuggaaauggcugcuucgaguuuuaccauaaguguaacgacgaaugcauggagagugucaaaaaugggacguaugauuaccccaaguauuccgaagagagcaaauugaaccgggagaagaucgacggagugaagcucgaaucuaugggugucuaccagauccuggccauuuauucaaccguggcuaguagcuuaguucugcuagugucccucggcgccaucucuuucuggaugugcucgaaugggagccugcagugucguauuugcauauga

SEQ ID NO: 128664 - RNA, 1698 nt, Artificial Sequence
  derived and/or modified sequence opt3 from hemagglutinin__InfluenzaA__AEA73595
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccauacugagaaugccuacguguccgucguuucaagccacuauagucgcaaguucacccccgaaauagcuaagcgaccuaaagugcgugaucaggagggcagaaucaacuacuauuggacacuucuggagccaggggacacuauuaucuuugaagcaaauggaaacuugauugccccgagguacgcuuucgcccucucucgggguuuuggcuccgggaucauaaauagcaacgcgcccauggauaagugugacgcaaaaugccagaccccucgcggagccauuaauucgucucugccauuccaaaacguacaucccgugacaaucggcgaguguccuaaguaugucagauccgcuaaauuaaggauggugaccggucugcggaauauuccaucaauccagagucgcgggcucuuuggagccaucgcaggcuucauugaaggcggguggacgggaaugguugaugguugguacggcuaucaccaccagaacgagcaggggagcggauacgcugccgaccaaaaguccacucagaaugcgauaaacggcaucacaaauaaagugaacucugucauugaaaagaugaauacccaguuuacugccguggguaaggaguucaacaaacuugagcgaagaauggaaaaccugaauaagaaaguagaugacggguucaucgauauauggacauacaacgcagaguugcuaguucugcucgaaaaugagaggacccuggacuuucaugacagcaacgugaagaaucuuuaugaaaaagucaagucacagcugaagaacaaugcuaaagagauuggcaacggaugcuucgaguuuuaccacaaguguaaugaugaaugcauggagagugugaaaaacggcacguaugacuaccccaaguauuccgaagagagcaaauugaaucgggagaagaucgauggggucaagcucgaaucuaugggaguguaccaaauccuggccauuuauucaaccguugcuaguagcuuagugcugcuaguaucccucggugccaucucuuucuggaugugcucgaacggcagccugcagugucguauuugcauauga

SEQ ID NO: 128665 - RNA, 1698 nt, Artificial Sequence; identical to SEQ ID NO: 127969
  derived and/or modified sequence opt3 from hemagglutinin__InfluenzaA__AEA73606

SEQ ID NO: 128666 - RNA, 1698 nt, Artificial Sequence; identical to SEQ ID NO: 125147
  derived and/or modified sequence opt3 from hemagglutinin__InfluenzaA__AEA73617

SEQ ID NO: 128667 - RNA, 1698 nt, Artificial Sequence; identical to SEQ ID NO: 125632
  derived and/or modified sequence opt3 from hemagglutinin__InfluenzaA__AEA73628

SEQ ID NO: 128668 - RNA, 1698 nt, Artificial Sequence; identical to SEQ ID NO: 127988
  derived and/or modified sequence opt3 from hemagglutinin__InfluenzaA__AEA73639

SEQ ID NO: 128669 - RNA, 1698 nt, Artificial Sequence; identical to SEQ ID NO: 125147
  derived and/or modified sequence opt3 from hemagglutinin__InfluenzaA__AEA73650

SEQ ID NO: 128670 - RNA, 1698 nt, Artificial Sequence; identical to SEQ ID NO: 125632
  derived and/or modified sequence opt3 from hemagglutinin__InfluenzaA__AEA73661

SEQ ID NO: 128671 - RNA, 1698 nt, Artificial Sequence
  derived and/or modified sequence opt3 from hemagglutinin__InfluenzaA__AEA73672
augaaggugaaacugcucguccuucugugcaccuucacagccacuuuugcugacacgaucuguauuggcuaccacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuauaucguugaaaagccaaacccggagaauggaaccuguuaccccggccauuucgcugauuaugaggaacugagagagcaacucucuucggugagcucauuugaaagguucgagauuuuuccuaaggagaguuccuggccaaaccacacugucacaggugugucugccagcugcucccauaauggggaaucaaguuucuaccggaacuuacuguggcuuaccguaaagaauggauuguaucccaaccugagcaaaucuuacgcaaauaacaaagagaaggaaguucuagugcucuggggcguccaccacccuccaaacaucguggaccagaaaacgcuguaucgcacugagaaugccuacguguccgucguuucaagccauuacagucgaaaguuuacccccgaaauagcuaagcguccuaaagugagagaucaggagggcaggaucaacuauuacuggacacuucuggagccaggggacacuauuaucuucgaagcaaauggaaacuugauugccccgcgguaugcuuuugcccucucucgcgguuucggcuccgggaucauaaauagcaacgcgcccauggauaagugugacgcaaaaugccagaccccuagaggagccauuaauucgucucugccauuucaaaacguacaccccgugacaaucggcgaguguccuaaguacgucagguccgcuaaauuacggauggugaccggucugcgcaauauuccaucaauccagagucgaggacucuucggggccaucgcaggcuuuauugaaggcggguggacgggaaugguugaugguugguauggcuaccaucaccagaacgagcaggggagcggauaugcugccgaccaaaaguccacucagaaugcgauaaacggcaucacaaauaaagugaacucugucauugaaaagaugaauacccaguucacugccguggguaaggaguucaacaaacuugagagaaggauggaaaaccugaauaagaaaguagaugacggguuuaucgauauauggacauacaacgcagaguugcuaguucugcucgaaaaugagcggacccuggacuuccacgacagcaacgugaagaaucuuuacgaaaaagucaagucacagcugaagaacaaugcuaaagagauuggcaacggaugcuuugaguucuaucauaaguguaaugaugaaugcauggagagugugaaaaacggcacguacgacuaucccaaguacuccgaagagagcaaauugaaucgugagaagaucgauggggucaagcucgaaucuaugggaguguaucaaauccuggccauuuacucaaccguugcuaguagcuuagugcugcuaguaucccucggugccaucucuuuuuggaugugcucgaacggcagccugcagugucgcauuugcauauga

SEQ ID NO: 128672 - RNA, 1698 nt, Artificial Sequence; identical to SEQ ID NO: 125632
  derived and/or modified sequence opt3 from hemagglutinin__InfluenzaA__AEA73683

SEQ ID NO: 128673 - RNA, 1698 nt, Artificial Sequence
  derived and/or modified sequence opt3 from hemagglutinin__InfluenzaA__AEA73694
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucacccccgaaauagcuaagcguccuaaagugagagaucaggagggcaggaucaacuacuauuggacacuucuggagccaggggacacuauuaucuuugaagcaaauggaaacuugauugccccgcgguacgcuuucgcccucucucgcgguuuuggcuccgggaucauaaauagcaacgcgcccauggauaagugugacgcaaaaugccagaccccuagaggagccauuaauucgucucugccauuccaaaacguacaccccgugacaaucggcgaguguccuaaguaugucagguccgcuaaauuacggauggugaccggucugcgcaauauuccaucaauccagagucgagggcucuuuggagccaucgcaggcuucauugaaggcggguggacgggaaugguugaugguugguacggcuaucaucaccagaacgagcaggggagcggauacgcugccgaccaaaaguccacucagaaugcgauaaacggcaucacaaauaaagugaacucugucauugaaaagaugaauacccaguuuacugccguggguaaggaguucaacaaacuugagagaaggauggaaaaccugaauaagaaaguagaugacggguucaucgauauauggacauacaacgcagaguugcuaguucugcucgaaaaugagcggacccuggacuuucacgacagcaacgugaagaaucuuuaugaaaaagucaagucacagcugaagaacaaugcuaaagagauuggcaacggaugcuucgaguuuuaccauaaguguaaugaugaaugcauggagagugugaaaaacggcacguaugacuaccccaaguauuccgaagagagcaaauugaaucgugagaagaucgauggggucgaacucgagucuaugggaguguaccaaauccuggccauuuauucaaccguugcuaguagcuuagugcugcuaguaucccucggugccaucucuuucuggaugugcucgaacggcagccugcagugucgcauuugcauauga

SEQ ID NO: 128674 - RNA, 1698 nt, Artificial Sequence; identical to SEQ ID NO: 125632
  derived and/or modified sequence opt3 from hemagglutinin__InfluenzaA__AEA73705

SEQ ID NO: 128675 - RNA, 1698 nt, Artificial Sequence; identical to SEQ ID NO: 125147
  derived and/or modified sequence opt3 from hemagglutinin__InfluenzaA__AEA73716

SEQ ID NO: 128676 - RNA, 1698 nt, Artificial Sequence; identical to SEQ ID NO: 125147
  derived and/or modified sequence opt3 from hemagglutinin__InfluenzaA__AEA73727

SEQ ID NO: 128677 - RNA, 1698 nt, Artificial Sequence; identical to SEQ ID NO: 125147
  derived and/or modified sequence opt3 from hemagglutinin__InfluenzaA__AEA73738

SEQ ID NO: 128678 - RNA, 1698 nt, Artificial Sequence; identical to SEQ ID NO: 125147
  derived and/or modified sequence opt3 from hemagglutinin__InfluenzaA__AEA73749

SEQ ID NO: 128679 - RNA, 1698 nt, Artificial Sequence
  derived and/or modified sequence opt3 from hemagglutinin__InfluenzaA__AEA73760
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaaaucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucacccccgaaauagcuaagcguccuaaaaucagagaucaggagggcaggauuaacuacuauuggacacuucuggagccaggggacacuaucauuuuugaagcaaauggaaacuugaucgccccgcgguacgcuuucgcccucucucgcgguuuuggcuccgggauaauuaauagcaacgcgcccauggauaagugugacgcaaaaugccagaccccuagaggagccaucaauucgucucugccauuccaaaacgugcaccccguaacaauuggcgaguguccuaaguaugugagguccgcuaaauuacggauggucaccggucugcgcaauaucccaucaauccagagucgagggcucuuuggagccauugcaggcuucauagaaggcggguggacgggaaugguggaugguugguacggcuaucaucaccagaacgagcaggggagcggauacgcugccgaccaaaaguccacucagaaugcgaucaacggcauuacaaauaaaguuaacucugugaucgaaaagaugaauacccaguuuacugccgucgguaaggaguucaacaaacuugagagaaggauggaaaaccugaauaagaaaguggaugacggguucauagauauuuggacauacaacgcagaguugcuaguacugcucgaaaaugagcggacccuggacuuucacgacagcaacguuaagaaucuuuaugaaaaagugaagucacagcugaagaacaaugcuaaagagaucggcaacggaugcuucgaguuuuaccauaaguguaaugaugaaugcauggagagugucaaaaacggcacguaugacuaccccaaguauuccgaagagagcaaauugaaucgugagaagaucgauggggugaagcucgaaucuaugggagucuaccaaauucuggccaucuauucaaccguggcuaguagcuuaguucugcuagugucccucggugccauuucuuucuggaugugcucgaacggcagccugcagugucgcauaugcaucuga

SEQ ID NO: 128680 - RNA, 1701 nt, Artificial Sequence; identical to SEQ ID NO: 124685
  derived and/or modified sequence opt3 from hemagglutinin__InfluenzaA__AEA73771

SEQ ID NO: 128681 - RNA, 1701 nt, Artificial Sequence; identical to SEQ ID NO: 126315
  derived and/or modified sequence opt3 from hemagglutinin__InfluenzaA__AEA73781

SEQ ID NO: 128682 - RNA, 1701 nt, Artificial Sequence; identical to SEQ ID NO: 126237
  derived and/or modified sequence opt3 from hemagglutinin__InfluenzaA__AEA73791

SEQ ID NO: 128683 - RNA, 1701 nt, Artificial Sequence; identical to SEQ ID NO: 124865
  derived and/or modified sequence opt3 from hemagglutinin__InfluenzaA__AEA73801

SEQ ID NO: 128684 - RNA, 1701 nt, Artificial Sequence; identical to SEQ ID NO: 125849
  derived and/or modified sequence opt3 from hemagglutinin__InfluenzaA__AEA73811

SEQ ID NO: 128685 - RNA, 1701 nt, Artificial Sequence; identical to SEQ ID NO: 126407
  derived and/or modified sequence opt3 from hemagglutinin__InfluenzaA__AEA73821

SEQ ID NO: 128686 - RNA, 1701 nt, Artificial Sequence
  derived and/or modified sequence opt3 from hemagglutinin__InfluenzaA__AEA73831
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcaccgaucaacagaguuuguaccagaacgccgacgcuuacguguucgucgggacaucucgcuauuccaagaaauuuaagccugagauugccauccgaccaaaagugcgugaucaggagggaagaaugaauuacuauuggacucugguggaacccggugacaagauuaccuucgaggcgacaggcaaccuagucguuccuagguacgcauuugccauggaacggaacgcugggagcggaaucauaauuucggauaccccagugcaugacugcaauacgacuugucaaacaccgaaaggcgccaucaacaccucucuccccuuccagaauauucacccuaucacuaucgguaagugcccaaaguauguaaaauccacaaagcugcgccuugcaaccgggcugagaaacgugcccucaauucagaguaggggauuguuuggcgcuauagccggcuucaucgaagggggauggacggguauggucgacggcugguacggguaucaucaccagaaugaacaaggaagcggcuacgcggccgaucucaaauccacccagaacgcaauugacaagaucacaaauaaagugaacucuguuauagagaagaugaauacucaguuuaccgcuguggguaaggaguucaaccaccuggaaaaacggauugagaauuuaaacaagaaagucgaugacggguuccuggauaucuggacauacaaugccgaacuccuugugcuguuggagaacgaacgcacucuagacuaucaugauagcaauguaaagaaccuguacgagaaaguucgaucacagcucaagaacaaugcuaaggagaucggcaacggauguuuugaguucuaucacaaaugcgacaauaccuguauggaaagugugaagaacggcacauacgauuauccuaaauacuccgaagaggccaagcugaauagagaagagauugacggggucaaacuugagagcaccaggaucuaucaaauucuggcaauauacucuacuguggccucaaguuugguccucgugguuagccugggagcuaucuccuuuuggaugugcucuaacgguucguuacagugccggauuuguaucuga

SEQ ID NO: 128687 - RNA, 1701 nt, Artificial Sequence
  derived and/or modified sequence opt3 from hemagglutinin__InfluenzaA__AEA73841
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagagagcgggaucauaauuucggacaccccagugcaugauugcaacacaaccugucaaacgccgaaaggagcuaucaauacuucucuccccuuccagaacauucacccuaucacaaucggcaagugcccaaaguauguaaaauccaccaagcugcgccuugccacuggucugagaaaugugcccucaauucagaguaggggguuguuuggagcgauagccggcuucaucgaaggcggguggacaggaauggucgacgguugguacggcuaucaucaccagaacgagcaagggagcggauacgcagcugaccucaaauccacccagaaugccauugauaagaucacgaacaaaguuaauucugugguggagaagaugaacacccaguuuacagcugucggcaaggaguucaaucaccuggagaaacggauagaaaacuuaaauaagaaaguggacgaugguuuccuggacauuuggacuuacaacgccgagcuccuuguacuguuggaaaaugagcgcacccuagauuaucaugacagcaacguuaagaaccuguacgagaaagugcgaucacagcucaagaauaacgcaaaggaaaucgggaauggcuguuuugaguucuaucacaaaugcgauaacacauguauggaaagugucaagaauggaacuuacgacuauccuaaauacuccgaggaagccaagcugaacagagaggagaucgauggcgugaaacuugaaagcaccaggauuuaucaaauccuggcuauuuacucuacagucgcgucaaguuuggugcucguugugagccugggggcaauauccuuuuggaugugcucuaauggaucguuacagugccggaucuguauuuga

SEQ ID NO: 128688 - RNA, 1701 nt, Artificial Sequence; identical to SEQ ID NO: 126315
  derived and/or modified sequence opt3 from hemagglutinin__InfluenzaA__AEA73851

SEQ ID NO: 128689 - RNA, 1701 nt, Artificial Sequence
  derived and/or modified sequence opt3 from hemagglutinin__InfluenzaA__AEA73861
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuuggugagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauguacacccuauuacaaucgguaaaugcccaaaguaugugaaguccaccaaacugcgccuugccacugggcugagaaacguccccucaauccagaguaggggauuguuuggcgcgauugccggcuucauagaagggggauggacagguaugguggacggcugguacggguaucaucaccagaaugagcaaggaagcggcuacgcagcugaucucaaguccacccagaacgccaucgacgagauuacgaauaaaguuaacucugugaucgaaaagaugaauacccaguuuacagcugucgguaaagaguucaaccaccuggaaaagcggauagagaauuuaaacaagaaaauugaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggaaagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 128690 - RNA, 1701 nt, Artificial Sequence; identical to SEQ ID NO: 126557
  derived and/or modified sequence opt3 from hemagglutinin__InfluenzaA__AEA73871

SEQ ID NO: 128691 - RNA, 1701 nt, Artificial Sequence; identical to SEQ ID NO: 126557
  derived and/or modified sequence opt3 from hemagglutinin__InfluenzaA__AEA73881

SEQ ID NO: 128692 - RNA, 1701 nt, Artificial Sequence; identical to SEQ ID NO: 126237
  derived and/or modified sequence opt3 from hemagglutinin__InfluenzaA__AEA73891

SEQ ID NO: 128693 - RNA, 1701 nt, Artificial Sequence
  derived and/or modified sequence opt3 from hemagglutinin__InfluenzaA__AEA73901
augaacgccauccuggugguccuccuuuacaccuucgcuacagcaaaugccgacacucugugcauuggcuaucacgcgaacaauagcacggauaccguugacacauuguuagagaagaacgugacuguaacccauuccgugaaucugcuagaagauaaacacaacgggaagcucuguaaacugagaggagucgcuccccuucaucuggguaagugcaauauagccggcuggaucuuggggaacccugagugugaaucucucucaacagcaaguagcugguccuacauuguggagaccucuucgucagacaauggaacuugcuauccaggcgauuuuaucgacuacgaggagcugagggagcagcugagcaguguuuccucuuucgaacgguuugagauuuucccgaaaacaagcuccuggcccaaccacgauucaaauaagggugugaccgccgcuuguccucaugcaggggccaagaguuuuuauaaaaaccucaucugguuagucaagaaaggaaauagcuacccaaagcugucuaaauccuauauaaacgacaagggcaaggaagugcuuguauuguggggcauccaccaccccucaacgagcgcugaucaacagagucuguaccagaaugccgacgcguacguuuucguggggacuucucgcuauuccaaaaaguuuaaaccugagauugcaauccgaccaaagguccgugaucaggagggaagaaugaacuacuauuggacccuaguggaacccggugacaaaauuacauucgaggccacuggcaaccucguggucccuagguacgcuuuugccauggaacggaaugcagggagcggaaucauaauuucggauaccccaguucaugacugcaacacaaccugucaaacgccgaagggcgcuaucaauacuucucugcccuuccagaacauucacccuaucacaaucgguaaaugcccaaaguaugugaaguccaccaaacuucgccuggccacuggguugagaaauguacccucaauucagaguaggggacucuuuggcgcgauagccggcuucaucgaagggggauggacagguaugguggacggcugguacggguaucaucaccagaacgaacaaggaagcggcuacgcagcugaucugaaguccacccagaaugccauugacgagaucacgaacaaaauaaauucugucauugagaagaugaacacccaguuuacagcuguggguaaagaguucaaucacuuagaaaagcggaucgaaaaccugaauaagaaaguugaugacggguuccucgauaucuggacuuacaacgccgagcuucugguguugcuagaaaaugagcgcacccuggacuaucaugauagcaacgucaagaaccucuacgagaaagugcgaucacagcugaagaauaacgcaaaagaaauuggcaauggauguuuugaguucuaucacaagugcgacaacacauguauggaaaguguaaagaauggcacuuacgauuauccuaaauacuccgaggaagccaaacuuaacagagaggagaucgacgggguuaagcuggaaagcaccaggauuuaucaaauauuggcuaucuacucuacaguggcgucaagucucguccugguggucagcuuaggagcaauuuccuuuuggaugugcucuaaugguucgcugcagugccggaucuguaucuga

SEQ ID NO: 128694 - RNA, 1701 nt, Artificial Sequence; identical to SEQ ID NO: 125849
  derived and/or modified sequence opt3 from hemagglutinin__InfluenzaA__AEA73911

SEQ ID NO: 128695 - RNA, 1701 nt, Artificial Sequence; identical to SEQ ID NO: 126557
  derived and/or modified sequence opt3 from hemagglutinin__InfluenzaA__AEA73921

SEQ ID NO: 128696 - RNA, 1701 nt, Artificial Sequence; identical to SEQ ID NO: 126315
  derived and/or modified sequence opt3 from hemagglutinin__InfluenzaA__AEA73931

SEQ ID NO: 128697 - RNA, 1701 nt, Artificial Sequence; identical to SEQ ID NO: 126315
  derived and/or modified sequence opt3 from hemagglutinin__InfluenzaA__AEA73961

SEQ ID NO: 128698 - RNA, 1701 nt, Artificial Sequence
  derived and/or modified sequence opt3 from hemagglutinin__InfluenzaA__AEA73971
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccagaaaucuacccagaacgccauugaugagaucacgaauaaggugaacagcguuauagagaaaaugaauacccaguuuacagcuguggguaaggaguucaaccaccucgaaaagcggauugagaaucugaacaaaaaggucgacgauggguucuuagacaucuggacuuacaaugccgaacugcucgugcuucuggagaacgagcgcaccuuggauuaucaugacucaaauguuaaaaaccuauacgaaaagguacgaagucaacugaaaaacaaugcaaaggagaucggcaacggauguuuugaguucuaucacaagugcaauaacacauguauggaauccgugaaaaauggcacuuacgauuaucccaaguacagcgaagaggccaaacucaacagagaggaaauugacggggucaagcuggagucuaccaggaucuaucagauucuugcuauauacucaacaguggcgaguagccuggucuuggugguuucccucggagcaaucucuuuuuggaugugcucgaaugguagccugcagugccggauuuguaucuga

SEQ ID NO: 128699 - RNA, 1701 nt, Artificial Sequence; identical to SEQ ID NO: 126315
  derived and/or modified sequence opt3 from hemagglutinin__InfluenzaA__AEA73981

SEQ ID NO: 128700 - RNA, 1701 nt, Artificial Sequence
  derived and/or modified sequence opt3 from hemagglutinin__InfluenzaA__AEA73991
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacucuuacguguucgucgggacuucccgguauagcaaaaaguuuaaaccugagauugcgauccgcccaaaggugcgagaucaggagggacguaugaauuacuauuggacccugguggaacccggugacaaaauuacauucgaggcaacuggcaaccuagucguuccuagauacgccuuugcuauggaaaggaacgccgggucgggaaucauaauuucugauaccccagugcaugacugcaauacaaccugucaaacgccggagggcgcaaucaacacuucccuccccuuccagaauauucacccuaucacaaucgguaagugcccaaaguauguaaaaucaaccaagcugcggcuugcuacugggcugcgcaacgugcccaguauucagagcagaggauuguuuggcgccauagcgggcuucaucgaagggggauggacagguauggucgacggcugguacggguaucaucaccagaaugagcaaggauccggcuacgccgcagaucucaaaucuacccagaacgcuauugacgagaucacgaauaaggugaacagcguuauagaaaagaugaauacccaguuuacagccguggguaaggaguucaaccaccuggaaaagaggauugagaauuuaaacaaaaaggucgaugacggguuccuggauaucuggacuuacaaugcugaacuccuugugcuguuggagaacgagcggacccuagacuaucaugauucaaauguuaaaaaccuguacgaaaagguacgcagucagcucaaaaacaaugccaaggagaucggcaacggauguuuugaguucuaucacaagugcgacaauacauguauggaguccgugaaaaacggcacuuacgauuauccuaaguacagcgaagaggcaaaacugaaucgagaggaaauugacggggucaaacuugagucuaccagaaucuaucaaauucuggccauauacucaacaguggcuaguagcuugguccucgugguuucccugggagcgaucucuuuuuggaugugcucgaacgguagcuuacagugcaggauuuguaucuga

SEQ ID NO: 128701 - RNA, 1701 nt, Artificial Sequence; identical to SEQ ID NO: 126298
  derived and/or modified sequence opt3 from hemagglutinin__InfluenzaA__AEA74001

SEQ ID NO: 128702 - RNA, 1701 nt, Artificial Sequence
  derived and/or modified sequence opt3 from hemagglutinin__InfluenzaA__AEA74011
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagcgcaacagcuacccaaaauuaucucaauccuauauaaaugacaagggaaaggaaguacugguucuuuggggcauccaccaccccucaacgagcgcugaucagcagaguuuguaccagaacgccgacgcguacguguucgucggcacuucucgauauuccaaaaaguuuaaaccugagauugcaauccguccaaaggugagagaucaagaggggaggaugaauuacuauuggacccugguggaacccggagacaaaauuacauucgaggccacugguaaccuagucguuccucgguacgcuuuugccauggaacgcaacgcaggcagcgggaucauaauuucggauaccccagugcaugacugcaauacaaccugucagacgccgaagggagcuaucaacacuucucuccccuuccagaauauucacccuaucacaaucggcaaaugcccaaaguauguaaaguccaccaaacugagacuugccacuggucugaggaacgugcccucaauucagagucggggguuguuuggagcgauagccggcuucaucgagggcggguggacaggaauggucgacgguugguacggcuaucaucaccaaaaugaacaggggagcggauacgcagcugaucucaaguccacccagaacgccauugacaaaaucacgaauaaggugaacucuguuauagagaaaaugaauacccaguuuacagcugugggcaaggaguucaaccaccuggaaaagcgcauugagaauuuaaacaaaaaggucgaugacgguuuccuggauaucuggacuuacaaugccgaacuccuugugcuguuggagaacgaacgaacccuagacuaucaugauagcaauguaaagaaccuguacgagaagguuagaucacaacucaaaaacaaugcaaaggagaucgggaacggcuguuuugaguucuaucacaagugcgacaauacauguauggagaguauuaaaaacggaacuuacgauuauccuaaguacuccgaagaggccaaacugaauagggaagagaucgacggcgugaaacuugagagcacccggauuuaucagauacuggcuaucuacucuacagucgcgucaaguuuggugcucgucgugagccugggggcaauuuccuuuuggaugugcucuaacggaucguuacagugccguaucuguaucuga

SEQ ID NO: 128703 - RNA, 1701 nt, Artificial Sequence
  derived and/or modified sequence opt3 from hemagglutinin__InfluenzaA__AEA74021
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucucaauccuauauaaaugacaagggcaaggaaguacugguucuuuggggcauccaccaccccucaacgagcgcugaucagcagaguuuguaccagaacgccgacgcguacguguucgucgggacuucucgcuauuccaaaaaguuuaaaccugagauugcaauccgaccaaaggugcgugaucaagagggaagaaugaauuacuauuggacccugguggaacccggugacaaaauuacauucgaggccacuggcaaccuagucguuccuagguacgcuuuugccauggaacggaacgcagggagcggaaucauaauuucggauaccccagugcaugacugcaauacaaccugucagacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccaaaaugaacagggaagcggcuacgcagcugaucucaaguccacccagaacgccauugacaaaaucacgaauaaggugaacucuguuauagagaaaaugaauacccaguuuacagcuguggguaaggaguucaaccaccuggaaaagcggauugagaauuuaaacaaaaaggucgaugacggguuccuggauaucuggacuuacaaugccgaacuccuugugcuguuggagaacgaacgcacccuagacuaucaugauagcaauguaaagaaccuguacgagaagguucgaucacaacucaaaaacaaugcaaaggagaucggcaacggauguuuugaguucuaucacaagugcgacaauacauguauggaaaguauuaaaaacggcacuuacgauuauccuaaguacuccgaagaggccaaacugaauagagaagagaucgacggggugaaacuugagagcaccaggauuuaucagauacuggcuaucuacucuacagucgcgucaaguuuggugcucgucgugagccugggagcaauuuccuuuuggaugugcucuaacgguucguuacagugccggaucuguaucuga

SEQ ID NO: 128704 - RNA, 1701 nt, Artificial Sequence
  derived and/or modified sequence opt3 from hemagglutinin__InfluenzaA__AEA74031
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaacaaucugaucuggcucgugaagaaaggaaacagcuacccaaaguuaaauaaaucuuauauaaacgauaagggcaaggaaguacugguucuuuggggcauccaccaccccuccacgucaacugaccaacagagcuuguaccagaaugcugaugccuacguguucgucgggaccagucgcuauucuaaaaaguuuaaaccugagauugcgauccgaccaaaggugcguaaccaggagggaagaaugaacuacuauuggacacugguggaacccggugacaaaauuacuuucgaggcaaccggcaaucuagucguuccuagguacgccuuugcuauggaacggaacgccggguccggaaucauaauuagcgauacaccaauccaugacugcaauaccacgugucaaacuccgaagggcgcaauuaacacaucgcuccccuuccagaauauccacccuaucaccauugguaaaugcccaaaguaugugaagucuacuaaacugcgccuugcuacagggcugagaaacguacccuccauacagucaaggggauuguuuggcgccaucgcgggcuucauugaagggggauggaccgguaugguggacggcugguacggguaucaucaccagaaugaacaaggaaguggcuacgccgcagaucucaagagcacgcagaacgcuaucgacgagauaaccaauaaagucaacuccgugauugagaagaugaauacacaguuuacugccguugguaaagaguucaaccaccuggaaaagcggaucgaaaauuuaaacaagaaaguggaugacggguuccuggauaucuggaccuacaaugcugagcuccuuguccuguuggaaaacgagcgcacacuagacuaucaugauucuaacgugaagaaucuguacgagaaaguacgaagccagcucaagaacaaugccaaagaaauuggcaacggauguuuugaguucuaucacaagugcgacaauacuuguauggaaucaguuaagaacggcaccuacgauuauccuaaauacagugaggaagcaaagcugaauagagaggagaucgacggggugaaacuugaauccacaaggauuuaucaaauacuggccaucuacagcaccgucgcuucuucauuggugcucgucgugagucugggagcgauuagcuuuuggaugugcuccaacgguucuuuacagugccggaucuguaucuga

SEQ ID NO: 128705 - RNA, 1701 nt, Artificial Sequence
  derived and/or modified sequence opt3 from hemagglutinin__InfluenzaA__AEA74035
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaacaaucugaucuggcucgugaagaaaggaaacagcuacccaaaguuaaauaaaucuuauauaaacgauaagggcaaggaaguacugguucuuuggggcauccaccaccccuccacgucaacugaccaacagagcuuguaccagaaugcugaugccuacguguucgucgggaccagucgcuauucuaaaaaguuuaaaccugagauugcgauccgaccaaaggugcgugaccaggagggaagaaugaacuacuauuggacacugguggaacccggugauaaaauuacuuucgaggcaaccggcaaccuagucguuccuagguacgccuuugcuauggaacggaaugccggguccggaaucauaauuagcgacacaccaauccaugacugcaacaccacgugucaaacuccgaagggcgcaauuaauacaucgcuccccuuccagaacauccacccuaucaccauugguaaaugcccaaaguaugugaagucuacuaaacugcgccuugcuacagggcugagaaauguacccuccauacagucaaggggauuguuuggcgccaucgcgggcuucauugaagggggauggaccgguaugguggauggcugguacggguaucaucaccagaacgaacaaggaaguggcuacgccgcagaccucaagagcacgcagaaugcuaucgaugagauaaccaacaaagucaauuccgugauugagaagaugaacacacaguuuacugccguugguaaagaguucaaucaccuggaaaagcggaucgaaaacuuaaauaagaaaguggacgauggguuccuggacaucuggaccuacaacgcugagcuccuuguccuguuggaaaaugagcgcacacuagauuaucaugacucuaacgugaagaaccuguacgagaaaguacgaagccagcucaagaauaacgccaaagaaauuggcaauggauguuuugaguucuaucacaagugcgauaacacuuguauggaaucaguuaagaauggcaccuacgacuauccuaaauacagugaggaagcaaagcugaacagagaggagaucgauggggugaaacuugaauccacaaggauuuaucaaauacuggccaucuacagcaccgucgcuucuucauuggugcucgucgugagucugggagcgauuagcuuuuggaugugcuccaaugguucuuuacagugccggaucuguaucuga

SEQ ID NO: 128706 - RNA, 1701 nt, Artificial Sequence; identical to SEQ ID NO: 124450
  derived and/or modified sequence opt3 from hemagglutinin__InfluenzaA__AEA77299

SEQ ID NO: 128707 - RNA, 1701 nt, Artificial Sequence; identical to SEQ ID NO: 128451
  derived and/or modified sequence opt3 from hemagglutinin__InfluenzaA__AEB21316

SEQ ID NO: 128708 - RNA, 1701 nt, Artificial Sequence; identical to SEQ ID NO: 128470
  derived and/or modified sequence opt3 from hemagglutinin__InfluenzaA__AEB21326

SEQ ID NO: 128709 - RNA, 1701 nt, Artificial Sequence; identical to SEQ ID NO: 128451
  derived and/or modified sequence opt3 from hemagglutinin__InfluenzaA__AEB21338

SEQ ID NO: 128710 - RNA, 1701 nt, Artificial Sequence; identical to SEQ ID NO: 128470
  derived and/or modified sequence opt3 from hemagglutinin__InfluenzaA__AEB21348

SEQ ID NO: 128711 - RNA, 1701 nt, Artificial Sequence; identical to SEQ ID NO: 125604
  derived and/or modified sequence opt3 from hemagglutinin__InfluenzaA__AEB40206

SEQ ID NO: 128712 - RNA, 1701 nt, Artificial Sequence; identical to SEQ ID NO: 125604
  derived and/or modified sequence opt3 from hemagglutinin__InfluenzaA__AEB66895

SEQ ID NO: 128713 - RNA, 1698 nt, Artificial Sequence
  derived and/or modified sequence opt3 from hemagglutinin__InfluenzaA__AEB71102
auggacgugcccgucuucguucugcucaugcuuaccagcaucugcgugcaggccgauagaauuuguguaggcuaccuguccacaaacucuucagagaggguggacacuuuguuagaaaauaacgucccugugacgaguagcguugaucugguggagaccaaucacacagggacuuauugcucccuaggagguauaucuccaguccaucucggcgacuguucguuugaaggguggaucgugggaaacccggcuugcgcaucaaaucugggcauucgggaguggagcuaccuuaucgaagaucccagugccccucacggucuguguuauccaggggaguuggacaacaauggagagcuccgccaucuguucuccggcauucgaucuuuuagccguaccgaacugaucgcgcccacauccuggggcgagguaaacgaugggguuaccgcugccugccaagacaagggagcaucaaguuucuacagaaaucucgugugguuugucgaaagggguaacaaauauccugugauacggcgcacuuacaauaacacaaccggcagagauguguuagucaucugggggauucaccauccaguuagcacggacgaggccaggaagcuguaugcuaaagauaaucccuacacucuugugucuaccuccucauggagccggaaguacaacuuggagacaggaacucgcccuggcuauaauggucagaaaaguuggaccaagaucuacugguaucugaugcacccaggggacucuauuuccuucgaaagcaacggaggccuacucgcaccgaaguacggcuauaucauagaggaauacgggaaaggacgaauuuuucagucgagaaucaggauugccaaguguaacacaaaaugccagaccucuguagguggcaucaauacgaacaagacuuuccaaaauaucgagcggaacgcucugggggauugucccaaauauauuaaguccggacagcuuaagcuggccacaggcuugcguaaugugccugcgauaucaaaccgcggucucuuuggggcaaucgccggcuucauugaaggaggcuggccagggcugaucaauggaugguacgguuuucagcaccagaacgagcaaggcauggggauggcugccgacaaagagaguacccagaaggcaauagaccagauuacuacaaaaaucaauaacaucauugaaaagaugaauggaaacuacgauagcaucagaggcgaguucucccaggucgaacaaaggauuaauauguuagcugaccggauagaugacgccgugaccgauguuuggucuuauaacgcgaaacugcucgugcuucuggagaaugacaagacguuggauaugcaugacgccaacguccgaaaccuacacgaucaggugcgcagaguacugaggaccaaugcaaucgacgaagguaacgggugcuuugagcuccugcauaaauguaaugauagcugcauggagacaauucggaacggcacuuacaaucacaucgaauaugaggaagagucaaaacuuaagcgccaggaaaucgagggaauuaaacugaagagugacgacaacguuuacaaggcuuuguccauauauagcugcaucgccucuucaauugugcucgucggccugaucuuagcuuucauuaugugggccuguaguagcgggaauugcagauucaacaucuguauauga

SEQ ID NO: 128714 - RNA, 1698 nt, Artificial Sequence
  derived and/or modified sequence opt3 from hemagglutinin__InfluenzaA__AEB71896
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccaugggcaagugugaugcaaaaugccagaccccucaaggugccauuaauucgucucugccauuccagaacgugcaccccguaacaaucggggaguguccuaaguaugugagauccgcuaaauuaaggauggucaccggacugcggaauauuccaucaauccagagucgcggccucuuuggcgccaucgcaggguucauugaaggagguuggacgggcaugguggacgggugguacggauaucaucaccagaacgagcaaggcagcgguuacgcugccgaucagaaguccacucagaaugcgauaaacgggaucacaaauaaaguuaacucugugauugaaaagaugaauacccaguuuacugccgucggcaaggaguucaacaaacuugagcgaagaauggaaaaccugaauaagaaaguggacgauggauucaucgacauauggacauacaacgcagaguugcuaguacugcucgaaaaugagaggacccuggauuuucacgacagcaacguuaagaaucuuuaugaaaaagugaagucacaacugaagaacaaugcuaaagagauuggcaacgggugcuucgaguuuuaccauaaguguaaugacgaaugcauggagagugucaaaaacggaacguaugauuaccccaaguauuccgaagagagcaaauugaauaaggagaagaucgacggugugaaacucgaaucuaugggcgucuaccagauccuggccauuuauucaaccguggcuaguagcuuaguucugcuagugucccucggggccaucucuuucuggaugugcucgaacggaagccugcagugucggauuugcauauga

SEQ ID NO: 128715 - RNA, 1701 nt, Artificial Sequence; identical to SEQ ID NO: 124927
  derived and/or modified sequence opt3 from hemagglutinin__InfluenzaA__AEB71916

SEQ ID NO: 128716 - RNA, 1701 nt, Artificial Sequence; identical to SEQ ID NO: 124450
  derived and/or modified sequence opt3 from hemagglutinin__InfluenzaA__AEB71925

SEQ ID NO: 128717 - RNA, 1701 nt, Artificial Sequence; identical to SEQ ID NO: 124450
  derived and/or modified sequence opt3 from hemagglutinin__InfluenzaA__AEB71936

SEQ ID NO: 128718 - RNA, 1701 nt, Artificial Sequence; identical to SEQ ID NO: 124450
  derived and/or modified sequence opt3 from hemagglutinin__InfluenzaA__AEB71947

SEQ ID NO: 128719 - RNA, 1698 nt, Artificial Sequence; identical to SEQ ID NO: 127988
  derived and/or modified sequence opt3 from hemagglutinin__InfluenzaA__AEB71958

SEQ ID NO: 128720 - RNA, 1701 nt, Artificial Sequence; identical to SEQ ID NO: 127435
  derived and/or modified sequence opt3 from hemagglutinin__InfluenzaA__AEB71969

SEQ ID NO: 128721 - RNA, 1701 nt, Artificial Sequence
  derived and/or modified sequence opt3 from hemagglutinin__InfluenzaA__AEB71980
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucguggagagauccaaagccuacucuaauugcuaucccuacgacgucccugauuaugcaucguugaggucacucguggccagcaguggcacucuggaauuuaacaaugaguccuucaacuggacagguguuacccagaaugggacgucuagcgcuuguauccggcgcuccaacaauucauuuuucagucgacugaacuggcucacucauuuaaaguuuaaguacccagcacugaaugugaccaugcccaacaacgagcaguucgacaaacuuuauauuuggggaguccaccauccuggcacagauaaugaccagaucuuuuuguacgcccaagcuagcggccguauuacugugucuaccaagagaucccagcagacaguaaucccaaacauagggucaaggccccggguucgcaauauuccuagcagaaucaguauuuauuggaccaucgugaaaccaggagauauccugcuaauuaacucuacggguaaucucauagccccgaggggcuacuucaagauccgguccgggaaaagcucgauuaugcgcucugacgcgcccaucggaaagugcaacuccgaauguauaacuccuaauggcucaauuccaaacgacaagcccuuucagaaugucaaccgaaucacauacggugcaugcccuagauaugugaaacaaaauacccugaagcuggccacugggaugaggaacgugccagagaaacagacacggggaaucuucggcgcuauugccggcuuuaucgaaaaugggugggagggaauggucgaugguugguacggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguauguggaggauaccaaaaucgacuuauggucuuacaaugccgaacugcucguagcacuugagaaccagcauacaauugaucugacugacagcgaaaugaauaaguuguucgagaaaaccaagaaacagcuacgggaaaacgcugaggauaugggcaauggauguuuuaagauauaucacaagugcgacaacgccugcaucggcucaauucgaaaugggacauacgaucaugacguguaucgcgacgaggcucugaacaauagauuccagaucaaaggagucgaacucaagagugguuacaaagauuggauucuguggaucuccuuugccauaagcuguuuccuucugugcguggcauugcucggcuuuaucaugugggccugucaaaaggggaacauuaggugcaauaucuguauuuga

SEQ ID NO: 128722 - RNA, 1698 nt, Artificial Sequence; identical to SEQ ID NO: 125632
  derived and/or modified sequence opt3 from hemagglutinin__InfluenzaA__AEB71992

SEQ ID NO: 128723 - RNA, 1698 nt, Artificial Sequence; identical to SEQ ID NO: 125632
  derived and/or modified sequence opt3 from hemagglutinin__InfluenzaA__AEC13313

SEQ ID NO: 128724 - RNA, 1701 nt, Artificial Sequence
  derived and/or modified sequence opt3 from hemagglutinin__InfluenzaA__AEC46553
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcacgucuuauauaaaugacaagggcaaggaaguacugguucuuuggggcauccaccacccuuccacuucagcugaucaacagagcuuguaccagaacgccgacgcguacgcauucguggggaccagucgcuauucuaaaaaguuuaaaccagagauugccauccgacccaagguccgugaucaggagggaagaaugaauuacuauuggacacugguggaaccuggugacaaaauuacuuucgaggcuaccggcaaccuaguggucccaagguacgccuuugcaauggaacggaacgcuggguccggaaucauaauuagcgauacaucgguucaugacugcaauaccacgugucaaacuccgaagggcgccaucaacacaucucuccccuuccagaaugugcacccuauuaccaucgguaaaugcccaaaguauguaaaguccacuaaacugcgccuugcgacagggcugagaaacgugcccucaauccagaguaggggauuguuuggcgccauugcaggcuucauagaagggggauggaccgguauggucgacggcugguacggguaucaucaccagaaugaacaaggaagcggcuacgcugccgaucucaaguccacgcagaacgcuuuugacaaaaucaccaauaaggugaacucuguuauugagaaaaugaauacacaguucacugccguggguaaggaguucaaccaccuggaaaagcggaucgagaauuuaaacaaaaaggucgaugacggguuucuggauauauggaccuacaaugcagaacuccuugugcuguuggagaacgaacgcacacuagacuaucaugauagcaauguaaagaaccuguacgagaagguucgaucacagcucaaaaacaaugccaaggagauuggcaacggauguuucgaauuuuaucacaagugcgacaauacuuguauggagagugugaaaaacggcaccuacgauuauccuaaguacuccgaagaggcuaaacugaauagagaagagaucgacggggucaaacuugagagcacaaggaucuaucaaauucuggcgaucuacucuaccguggcaucaaguuugguccucgugguuagccugggagccauuuccuucuggaugugcucuaacgguucguuacagugccggauauguaucuga

SEQ ID NO: 128725 - RNA, 1701 nt, Artificial Sequence
  derived and/or modified sequence opt3 from hemagglutinin__InfluenzaA__AEC46555
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcacgucuuauauaaaugacaagggcaagaaaguacugguucuuuggggcauccaccacccuuccacuucagcugaucaacagagcuuguaccagaacgccgacgcguacgcauucguggggaccagucgcuauucuaagaaauuuaagccagaaauugccauccgacccaaaguccgugaucaggagggaagaaugaauuacuauuggacacugguggagccuggugacaagauuacuuucgaagcuaccggcaaccuaguggucccaagguacgccuuugcaauggagcggaacgaaggguccggaaucauaauuagcgauacaucgguucaugacugcaauaccacgugucaaacuccgaaaggcgcuaucaacacaucucuccccuuccagaaugugcacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccuuugacaagaucaccaauaaagugaacucuguuauugagaagaugaauacacaguucacugcuguggguaaggaguucaaccaccuggaaaaacggaucgagaauuuaaacaagaaagucgaugacggguuucuggauauauggaccuacaaugccgaacuccuugugcuguuggagaacgaacgcacacuagacuaucaugauagcaauguaaagaaccuguacgagaaaguucgaucacagcucaagaacaaugcaaaggagauuggcaacggauguuucgaauuuuaucacaaaugcgacaauacuuguauggagagugugaagaacggcaccuacgauuauccuaaauacuccgaagaggccaagcugaauagagaagagaucgacggggucaaacuugagagcacaaggaucuaucaaauucuggcuaucuacucuaccguggcgucaaguuugguccucgugguuagccugggagcaauuuccuucuggaugugcucuaacgguucguuacagugccggauauguaucuga

SEQ ID NO: 128726 - RNA, 1701 nt, Artificial Sequence; identical to SEQ ID NO: 128724
  derived and/or modified sequence opt3 from hemagglutinin__InfluenzaA__AEC46557

SEQ ID NO: 128727 - RNA, 1701 nt, Artificial Sequence; identical to SEQ ID NO: 124672
  derived and/or modified sequence opt3 from hemagglutinin__InfluenzaA__AEC53259

SEQ ID NO: 128728 - RNA, 1701 nt, Artificial Sequence
  derived and/or modified sequence opt3 from hemagglutinin__InfluenzaA__AEC53269
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcugcugagcaguguguccucuuucgaacgguuugagauuuucccgaagacaagcuccuggcccaaucacgauucaaacaagggugucaccgccgcuuguccucaugcaggggccaaaaguuuuuauaagaaucucaucugguuagugaaaaagggaaacagcuacccaaaacugucuaaguccuauauaaaugacaagggcaaagaaguacuuguuuuguggggcauccaccaccccucaacgagcgcugaucagcaaagucuguaccagaacgccgacgcguacguguucgucgggucuucccgcuauagcaagaaauuuaagccugagauugcaauccgaccaaaagugcgugaucaggagggaagaaugaauuacuauuggacucuaguggaacccggugacaagauuaccuucgaggccacaggcaaccucgucguuccuagguacgcuuuugccauggaacggaacgcagggucgggaaucauaauuucugauacuccagugcaugacugcaauaccacaugucagaccccgaaaggcgcuaucaacacgucccugcccuuccaaaauauucacccuaucacuaucgguaagugcccaaaguauguaaaaucaacaaaacuucgccuggccaccggguugagaaacauucccaguauacagagcaggggacucuuuggcgcgaucgccggcuucauugaagggggauggacugguaugguggacggcugguacggguaucaucaccagaaugaacagggauccggcuacgcagcugaucugaagucuacacaaaacgccaucgacgagauaaccaauaaggucaacagcgugauugagaaaaugaauacgcaguuuaccgcuguugguaaggaguucaaccacuuagaaaagcggaucgaaaaucugaacaaaaagguggaugacggguuccucgauaucuggacauacaaugccgagcuucuggucuugcuagaaaacgagcgcacucuggacuaucaugauucaaaugugaaaaaccucuacgagaagguacgaagucagcugaaaaacaaugcaaaggaaauuggcaacggauguuuugaguucuaucacaagugcgacaauaccuguauggaauccguuaaaaacggcacauacgauuauccuaaguacagcgaggaagccaaacuuaauagagaggagaucgacggggugaagcuggaaucuacuaggauuuaucagauauuggcuaucuacucaaccgucgcgaguagccucgugcuggucguguccuuaggagcaauuucuuuuuggaugugcucgaacgguagccugcaaugccggaucuguaucuga

SEQ ID NO: 128729 - RNA, 1701 nt, Artificial Sequence; identical to SEQ ID NO: 125415
  derived and/or modified sequence opt3 from hemagglutinin__InfluenzaA__AEC53279

SEQ ID NO: 128730 - RNA, 1701 nt, Artificial Sequence; identical to SEQ ID NO: 124672
  derived and/or modified sequence opt3 from hemagglutinin__InfluenzaA__AEC53289

SEQ ID NO: 128731 - RNA, 1701 nt, Artificial Sequence; identical to SEQ ID NO: 124672
  derived and/or modified sequence opt3 from hemagglutinin__InfluenzaA__AEC53299

SEQ ID NO: 128732 - RNA, 1701 nt, Artificial Sequence; identical to SEQ ID NO: 124865
  derived and/or modified sequence opt3 from hemagglutinin__InfluenzaA__AEC53327

SEQ ID NO: 128733 - RNA, 1701 nt, Artificial Sequence
  derived and/or modified sequence opt3 from hemagglutinin__InfluenzaA__AEC53347
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugauugaacccggugacaagaucaccuucgaggccacaggcaaccuaguggucccuagguacgcuuuugccauggaacggaacgcagggucgggaauaauuaucucugauacuccaguucaugacugcaauaccacaugucaaaccccgaaaggcgcuauuaacacgucccuccccuuccagaauauccacccuaucacuauugguaagugcccaaaguaugugaaaucaacaaagcugcgccuugccaccgggcugagaaacguacccaguauacagagcaggggauuguuuggcgcgaucgccggcuucauugaagggggauggacugguaugguggacggcugguacggguaucaucaccagaaugaacaaggauccggcuacgcagcugaucucaaaucuacacagaacgccaucgacgagauaaccaauaaggucaacagcgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 128734 - RNA, 1701 nt, Artificial Sequence
  derived and/or modified sequence opt3 from hemagglutinin__InfluenzaA__AEC53404
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaaggguauaaccgccgcuuguccucaugcaggggccaaaaguuuuuauaagaaucugaucuggcuggucaaaaagggaaacagcuacccaaaacucucuaaguccuauauuaaugacaagggcaaagaaguguuaguacuguggggcauccaccaccccucaacgagcgcugaucaacagagucuuuaccagaacgccgacgcguacguuuucguggggucuucccgcuauagcaagaaauuuaagccugagauugcaauccgaccaaaaguccgugaucaggagggaagaaugaauuacuauuggacuuugguggaacccggugacaagauaaccuucgaggccacaggcaaccugguggucccuagguacgcuuuugccauggaacggaacgcagggucgggaauuaucauuucugauacuccaguucaugacugcaauaccacaugucaaaccccgaaaggcgcuaucaacacgucccuacccuuccagaauauccacccuauuacuauagguaagugcccaaaguaugugaaaucaacaaagcuccgccuggccaccgggcuuagaaacguacccaguauccagagcaggggacuguuuggcgcgauugccggcuucaucgaagggggauggacugguaugguggacggcugguacggguaucaucaccagaaugaacaaggauccggcuacgcagcugauuugaaaucuacacagaacgccauagacgagauuaccaauaaggucaacagcgugaucgagaaaaugaauacgcaguuuaccgcuguugguaaggaguucaaccaccucgagaagcggaucgaaaaucugaacaaaaagguggaugacggguucuuagauauuuggacauacaaugccgagcugcucguccuucuggaaaacgagcgcacuuuggacuaucaugauucaaaugugaaaaaccuauacgagaagguacgaagucagcugaaaaacaaugcaaaggaaaucggcaacggauguuuugaguucuaucacaagugcgacaauaccuguauggaauccguuaaaaacggcacauacgauuauccuaaguacagcgaggaagccaaacucaauagagaggagauugacggggugaagcuggaaucuacuaggauauaucaaauccuugcuauuuacucaaccgucgcgaguagccugguguuggucgugucccucggagcaaucucuuuuuggaugugcucgaacgguagccugcagugccggaucuguauuuga

SEQ ID NO: 128735 - RNA, 1701 nt, Artificial Sequence; identical to SEQ ID NO: 124672
  derived and/or modified sequence opt3 from hemagglutinin__InfluenzaA__AEC53414

SEQ ID NO: 128736 - RNA, 1701 nt, Artificial Sequence
  derived and/or modified sequence opt3 from hemagglutinin__InfluenzaA__AEE27177
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacauauuagaagauaagcacaaugggaaacuguguaagcuaagaggaguggcgccccuccaucuggguaaaugcaacaucgcuggcuggauucuugggaauccugagugugaaucucugucaaccgccaguagcugguccuacaucguugagacuucuucgucagacaacggaacaugcuauccaggcgauuuuauugacuacgaagaguugagggagcagcucagcaguguguccucuuucgaacgguuugagaucuucccgaagaccagcuccuggcccaaucacgauucaaacaagggugucacggcagccuguccucaugcuggggcaaaaaguuuuuauaagaaucugauauggcuggugaaaaagggaaacagcuacccaaaacucucuaaguccuauaucaaugacaagcgcaaagaaguauuaguucuguggggcauucaccaccccucaacuagcgccgaucaacagagucuuuaccagaacgcugacgccuacguguucgucgggucuucccgauauagcaagaaauuuaagccugagaucgcgauucguccaaaagugagagaucaggagggcaggaugaauuacuauuggaccuugguggaacccggagacaagaucacauucgaggcaacugguaaccuggucguuccucgguacgccuuugcuauggaacgcaacgccggcucggggauaauuaucucugauaccccagugcaugacugcaauacaaccugucaaacgccgaaaggagcaauuaacacuucccuacccuuccagaauauccacccuaucacaauuggcaagugcccaaaguauguaaaaucaaccaagcucagacuggcuacuggucuuaggaacgugcccaguauacagagccgggggcuguuuggagccaucgcgggcuucauugagggcggguggacaggaauggucgacgguugguacggcuaucaucaccagaaugaacaaggguccggauacgccgcagauuugaaaucuacccagaacgcuaucgacgagauaacgaauaaggugaacagcguuauugagaaaaugaauacccaguuuacagccgugggcaaggaguucaaccaccucgaaaagcgcaucgaaaaucugaacaaaaaggucgaugacgguuucuuagauaucuggacuuacaaugcugagcugcucgugcuucuggaaaacgagcgaaccuuggacuaucaugauucaaauguuaaaaaccuauacgagaagguaagaagucagcugaaaaacaaugccaaggaaauugggaacggcuguuuugaguucuaucacaagugcgacaauacauguauggaauccgugaaaaacggaacuuacgauuauccuaaguacagcgaggaagcaaaacucaauagggaggagaucgacggcgucaagcuggaaucuacccggauuuaucaaauacuugccaucuacucaacaguggcuaguagccuggucuuggugguuucccucggggcgauuucuuuuuggaugugcucgaacggaagccugcagugccguaucuguaucuga

SEQ ID NO: 128737 - RNA, 1701 nt, Artificial Sequence; identical to SEQ ID NO: 126457
  derived and/or modified sequence opt3 from hemagglutinin__InfluenzaA__AEE27187

SEQ ID NO: 128738 - RNA, 1701 nt, Artificial Sequence
  derived and/or modified sequence opt3 from hemagglutinin__InfluenzaA__AEE27207
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaaaguaaagaaucuguacgagaaaguucgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128739 - RNA, 1701 nt, Artificial Sequence
  derived and/or modified sequence opt3 from hemagglutinin__InfluenzaA__AEG64752
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguacgcucaacaaaacugagacuugccaccgggcugaggaacgugcccaguauucagagccggggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaagaguucaaccaccuggaaaagcgcauugaaaauuuaaacaagaaagucgaugacggguuccuggauaucuggacauacaaugccgagcuccuugugcuguuggaaaacgagcgaacucuagacuaucaugauucaaauguaaagaaccuguacgagaaaguuagaaggcagcucaagaacaaugcaaaagaaaucggcaacggauguuuugaguucuaucacaagugcgacaauaccuguauggaaagugugaagaacggcacauacgauuauccuaaauacuccgaggaagccaagcugaaucgggaggagauugacggggucaaacuugaaagcacucguaucuaucaaauucuggcuauauacucuaccguggcgucaaguuugguccucgugguuagccugggagcaaucuccuuuuggaugugcucuaacgguucguuacagugccgcauuuguaucuga

SEQ ID NO: 128740 - RNA, 1701 nt, Artificial Sequence
  derived and/or modified sequence opt3 from hemagglutinin__InfluenzaA__AEG64762
augaaggccagacugcucgugcuucugugcgcuuuggcagccaccgacgcggauacaaucuguauuggcuaccacgcuaacaauagcacugacacggucgauaccuuacuggagaaaaacguuacagugacucauuccguaaaucuacucgaagacucucacaacgggaagcugugcaaacuuaagggaauagccccgcugcaguuggguaaauguaauaucgcaggcuggcuccuggggaacccugagugcgauucacugcucccagccaggaguuggagcuauauuguggaaacccccaauuccgagaacggagcuuguuaccccggcgacuucaucgauuaugaagaguuacgggagcaacugucuacagucucgucacuugaacgcuuugagauuuucccuaaggaaagcaguuggccaaaucauaacaccuugaagggugugacuguuuccugcucucacgggggaaaaagcuccuuuuaccgaaaucugcuauggcucacaaagaccggcgacucauaucccaaacugaacaauaguuacgugaacaauaagggcaaagagguccuugugcuguggggaguacaucacccuucuagcuccaacgagcagcagucauuguaucacaacguuaaugcauacgugagcgucgugaguucuaacuacaaucguagauucacgccagaaaucgccgcuaggcccaaggugcgggaucagccugggcgcaugaacuauuacuggacucuccuggagccaggugacaccauauuauuugaagccacaggcaaucugaucgcgccgugguaugcauucgcccucuccagaggguuuggaagcggcauuaucacuucgaacgcuucuaugcaugaguguaauaccaagugccaaacaccccagggugccauuaacuccucacuuccuuuccagaauauccacccagucaccauaggggaaugucccaaauacguuaggaguacgaagcugcggauggugacuggauugcgcaacauuccuagcauccagucccgaggccuauuuggcgcaauugcuggguucaucgagggagguuggacaggcaugaucgaugggugguauggauaccaucaccaaaaugagcagggcucugguuaugccgcggaccagaaaagcacccagaacgccauuaaugggauaacuaacaagguaaauucagugaucgaaaagaugaacacacaauuuaccgcagucggcaaagaguucaacaaucuggagaaaagaauggaaaaccucaauaagaagguggaugacggauuucuggacauuuggacguacaacgcugaacuucugguuuugcucgagaaugagaggacccuggauuuccacgacuuaaacgugaaaaaucuguacgaaaaggucaaaagucagcuaaagaacaaugccaaagagaucggcaacgggugcuucgaauuuuaucauaagugugauaaugagugcauggaauccgugcgggacggaacauacgauuauccaaaguacagcgaggagucuaaacucaaccgugaaaagauagacgguguaaaacuggagucaaugggcguuuaucagauucuugcuaucuacaguacuguggccagcuccuugguccugcucgugucucugggggcaaucucguucuggaugugcagcaauggaucccuucaaugucgcauuugcaucuga

SEQ ID NO: 128741 - RNA, 1701 nt, Artificial Sequence; identical to SEQ ID NO: 124685
  derived and/or modified sequence opt3 from hemagglutinin__InfluenzaA__AEG64784

SEQ ID NO: 128742 - RNA, 1701 nt, Artificial Sequence
  derived and/or modified sequence opt3 from hemagglutinin__InfluenzaA__AEG64834
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucagcuggugagauuugcgacaguccacaccagauccuagauggcgaaaacuguacacucauagacgcccugcuuggggauccgcagugcgacggauuucagaauaaaaagugggaucuguucguggagagaagcagggcauauuccaacuguuaccccuaugacgucccugauuacgccucuuugcggucgcucguggcuucaagcggcacccuggaauuuaauaacgagaguuucaauuggacugguguuacacagaacgggaccuccucugcaugcauccgccgaagcaauaacuccuuuuucucacgucugaauuggcucacgcauuuaaacuuuaaauauccagcccugaacgugacuaugcccaauaacgagcaguucgacaaacuuuacauuuggggaguccaccauccuggcaccgauaaggaccagaucuuuuuguaugcucaagccaguggcagaauuacagugagcacuaaaaggucucagcaggcgguaaucccaaauauagggucccggccccgcguuagaaacauuccuucaaggaucagcauuuacuggaccaucgugaagccaggagauauccugcuaauuaauaguacagguaaccucauagcaccgcggggcuacuucaaaauccgcucugggaaguccagcauuaugcgaucggacgcccccaucggaaaauguaauucugaaugcauaaccccuaacggcuccauuccaaaugacaagcccuuucagaacgucaauagaaucacguauggugcuuguccuagguacgugaagcaaucaacucugaaacuugccacagggaugcggaacgugccagagaagcagacccguggaaucuucggcgcaauugcuggcuuuaucgaaaaugggugggagggaauggucgaugguugguauggcuuccgccaccagaacagugaggggagaggacaagccgcggaccugaaaagcacucaggccgcaauugaucagauaaauggcaaguugaacaggcucaucgguaaaacaaacgaaaaguuccaccagauugagaaagaauuuuccgagguugaagggcggauccaagaccuggagaaguacguggaggauaccaagaucgacuuauggucuuauaaugcugaacugcucguagcccuugagaaccagcauacgauugaucugaccgacagcgaaaugaauaaauuguucgagaagacaaagaagcagcuacgagaaaacgcugaggauaugggcaauggaugcuuuaaaauauaccacaagugugacaacgccugcaucggcucaauucgcaaugggacuuaugaucaugacguguacagagacgaggcacugaacaauagguuccagaucaagggagucgaacucaaaagugguuacaaggauuggauucuguggaucuccuuugccauaagcugcuuccuucuguguguggcuuugcucggcuuuaucaugugggcgugccaaaaagggaacauucgguguaauaucugcauuuga

SEQ ID NO: 128743 - RNA, 1701 nt, Artificial Sequence
  derived and/or modified sequence opt3 from hemagglutinin__InfluenzaA__AEG64845
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcagacaguaaucccaaauauaggguccaggccccggguucgcaacauuccuucaagaaucagcauuuacuggaccaucgugaaaccaggagauauccugcuaauuaauaguacggguaaccucauagccccgaggggcuacuucaagauccggucugggaaauccagcauuaugcgcucggacgcgcccaucggaaaguguaauucugaaugcauaacuccuaacggcuccauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccaaaauucagaggggcgcggacaggcagcugaccugaagaguacccaggccgcgauugaucagauaaacggcaaauugaacagacucaucgguaagacgaaugaaaaauuccaccagauugagaaggaauuuagcgagguugaagggaggauccaagaccuggagaaguacguggaggauaccaaaaucgacuuaugguccuauaacgccgaacugcucguagcacuugagaaucagcauacaauugaucugacugacucugaaaugaacaaguuguucgagaaaaccaagaaacagcuacgggaaaaugcugaggauaugggcaacggaugcuuuaagauauaccacaagugugacaaugccugcaucggcagcauucgaaacgggacauaugaucaugacguguaccgcgacgaggcucugaauaacagauuccagaucaaaggagucgaacucaagucagguuacaaagauuggauucuguggaucaguuuugccauauccugcuuccuucuguguguggcauugcucggcuuuaucaugugggccugccaaaaggggaauauuagguguaacaucugcauuuga

SEQ ID NO: 128744 - RNA, 1701 nt, Artificial Sequence
  derived and/or modified sequence opt3 from hemagglutinin__InfluenzaA__AEG64856
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaagugugaugcgcagcgacgcauccaucggaaaauguaauucugaaugcauuaccccgaacggcagcauacccaaugacaagccuuuucagaacgucaaucgaaucacguacggugccuguccaagauauguuaaacagaacacucuuaagcuggcuacagggaugaggaaugugcccgagaaacaaacccggggaauuuucggcgccaucgcaggcuuuauagaaaacgggugggagggaaugguagaugguugguacggcuuccgucaccagaauagcgaggggacuggacaggcugccgacuugaagaguacacaagcggccauuaaccagaucaauggcaaacucaaccgccugaucgaaaagaccaaugagaaguuucaucagauugaaaaagaguucuccgaaguggaggguagaauccaggauuuagagaaguaugucgaagacacgaaaauugaucuguggagcuacaacgcagagcuccuuguggcucuggaaaaccaacacaccauagacuugacagauucugagaugaauaagcuauucgaaaggacuaaaaagcagcugcgggagaacgccgaggacauggggaauggcugcuuuaagaucuaucauaaaugugauaacgcuugcauugaaucaauccgaaauggaaccuacgaccacgauguuuaccgcgacgaggcccucaacaauagauuccagaucaagggcguggaacugaaaaguggguauaaggacuggauucuuuggauaucauuugcaaucuccugcuuccuguugugugucgugcuccugggauuuauuaugugggccugccagaaagguaacaucagguguaauauuugcaucuga

SEQ ID NO: 128745 - RNA, 1701 nt, Artificial Sequence; identical to SEQ ID NO: 122088
  derived and/or modified sequence opt3 from hemagglutinin__InfluenzaA__AEG64867

SEQ ID NO: 128746 - RNA, 1701 nt, Artificial Sequence
  derived and/or modified sequence opt3 from hemagglutinin__InfluenzaA__AEG64878
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcaucgggcaggcugccgauuugaaaucaacacaggcggccauuaaccaaaucaauggaaagcucaaccgccugauugagaaaaccaaugaaaaguuucaccagauagaaaaggaguucagugaaguggagggcagaauccaggacuuagagaaauaugucgaagauacgaagauugaccugugguccuacaacgcagagcuccuuguggcucuggaaaaccagcauaccaucgauuugacagacagcgagaugaauaaacuauucgaaaggacucggaagcaacugcgagagaacgccgaggauauggguaaugggugcuuuaaaaucuaucacaagugugacaacgcuugcauuggcucuauacgcaauggaaccuacgaucacgacguuuacagagaugaagcccucaacaauagguuccagaucaagggcguggagcugaaaucaggguauaaggacuggauucuuuggaucaguuuugcaauuagcugcuuccuguugugugucgugcuccugggauuuaucaugugggccugccagaaagguaacauacgguguaauaucugcauuuga

SEQ ID NO: 128747 - RNA, 1701 nt, Artificial Sequence
  derived and/or modified sequence opt3 from hemagglutinin__InfluenzaA__AEG64889
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacuguuugccagcaguggaacacuggaguucaacaaugaauccuuuaacuggaccggcguugcucagaaugguacgucuagcgcaugcaagcgccgauccauaaaaucauucuuuagucgucucaacugguuacaucaacugaaguauaaguacccagcccuuaaugugacuaugcccaacaaugagaaauucgacaaguuguauaucuggggaguccaccacccuagcaccgauucugaccagauuucccuguacgcucaggccucagggagagugacaguaagcacuaaaaggagucagcaaaccguuaucccaaacauuggcucucggcccugggugcgcggcgucuccagcagaaucucgauauacuggacaauugugaagccuggggauauccuacucauuaacucuaccggaaaucugaucgcgccaagggguuauuuuaaaauccgguccggcaagucaaguauuaugcgcagcaacgcaccgauagggaaguguaauuccgaaugcaucacgcccaacggaucuauuccuaaugacaaaccauuccagaacgugaaucgaaucacuuacggcgccugucccagauaugucaagcagaacacacuuaaacuggcuaccgguaugaggaauguuccugagaagcagacucgggggauauuuggagccauugcaggcuucaucgaaaacggcugggaggggaugguggacggaugguacgguuuucgucaucaaaauagcgagggcacagggcaggcugccgauuugaaaucaacccaggcggccaucaaccaaauuaauggaaagcucaaccgccugaucgagaaaacgaaugaaaaguuccaccagauugaaaaggaguucagugaaguagagggcagaauacaggacuuagagaaauauguggaagauaccaagaucgaccugugguccuacaacgcagagcuccuugucgcucuggaaaaccagcauacaauugauuugacugacagcgagaugaauaaacuauuugaaaagaccaggaaacaacugcgggagaacgccgaggauauggguaaugggugcuucaagaucuaucacaagugugacaacgcuugcaucggcucuauucgaaauggaacauacgaucacgacguguaccgcgaugaagcccucaacaauagauuucagauaaaaggcguugagcugaagucaggguauaaagacuggauccuuuggauuaguuucgcaaucagcugcuuucuguugugugugguccuccugggauucauuaugugggccugccagaaggguaacaucagguguaauauaugcaucuga

SEQ ID NO: 128748 - RNA, 1701 nt, Artificial Sequence; identical to SEQ ID NO: 122048
  derived and/or modified sequence opt3 from hemagglutinin__InfluenzaA__AEG64911

SEQ ID NO: 128749 - RNA, 1701 nt, Artificial Sequence; identical to SEQ ID NO: 122048
  derived and/or modified sequence opt3 from hemagglutinin__InfluenzaA__AEG64922

SEQ ID NO: 128750 - RNA, 1701 nt, Artificial Sequence; identical to SEQ ID NO: 122048
  derived and/or modified sequence opt3 from hemagglutinin__InfluenzaA__AEG64933

SEQ ID NO: 128751 - RNA, 1701 nt, Artificial Sequence; identical to SEQ ID NO: 122134
  derived and/or modified sequence opt3 from hemagglutinin__InfluenzaA__AEG64944

SEQ ID NO: 128752 - RNA, 1701 nt, Artificial Sequence; identical to SEQ ID NO: 122048
  derived and/or modified sequence opt3 from hemagglutinin__InfluenzaA__AEG64955

SEQ ID NO: 128753 - RNA, 1701 nt, Artificial Sequence; identical to SEQ ID NO: 122048
  derived and/or modified sequence opt3 from hemagglutinin__InfluenzaA__AEG64966

SEQ ID NO: 128754 - RNA, 1701 nt, Artificial Sequence
  derived and/or modified sequence opt3 from hemagglutinin__InfluenzaA__AEG64977
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagguauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucgacuggacagguguuacccagaacgggacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggaguccaccauccuggcacagacagcgaucagauuucuuuguacgcccaggcuuccggccguaucacugugucaaccaagagaagccaacagacaguaauuccaaacaucgggaguaggccccggguucgcgacgugucuuccagaauaagcauuuacuggaccaucgucaagccuggagacauucugcuaaucaacucgacggguaaucucaucgccccaaggggcuauuucaagauucggucugggaaauccucaauaaugcgcagugaugcgccgaucgacaaguguaacagcgaaugcauuacucccaauggauccaucccuaacgauaaaccauuucagaaugugaaccgaauaacauacggcgcaugucccagauaugugaagcagaauacccugaaacuugccacugguaugaggaacgucccugagaagcaaacacgggggauuuucggagcuaucgccggcuuuaucgaaaauggcugggaggggaugguugacggaugguacgguuuccgucaccagaacucugagggcaccgggcaggcagcugaucugaaaagcacgcaagccgcgauuaaucagaucaacggaaaguugaaucgccucauuggcaagaccaacgaaaaauuucaccagauagagaaggaguucucagaaguggaagguagaauccaggaccuggagaaauauguagaggauacaaagauugacuuauggaguuacaaugccgaacugcucguggcacuugagaaccaacauacuaucgaucugaccgacuccgaaaugaacaaauuguucgagaggacaaagaagcagcuacgggaaaaugcugaggauauggggaacggcugcuuuaaaaucuaucacaagugugacaaugccugcauuggaagcauacgaaacggcacuuacgaccaugaugucuaccgcgacgaggcucugaauaacagauuccagaucaaagggguggaacucaagucuggauauaaagauuggauucuguggaucucauuugccauuaguugcuuccuucuguguguugcauugcucgguuuuaucaugugggccugccagaagggcaauauaagguguaacaucugcauuuga

SEQ ID NO: 128755 - RNA, 1701 nt, Artificial Sequence
  derived and/or modified sequence opt3 from hemagglutinin__InfluenzaA__AEG64988
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacaugccacaccagauccuagauggcgaaaauuguacccucauagacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcaagcggcgcagcaacaauuccuuuuucucacgacugaacuggcucacucauuuaaaguuuaaauauccagcacugaaugugaccaugcccaacaacgagaaguucgacaaacuuuacaucuggggaguccaccauccuggcacagauaaugaccagauuuuucuuuaugcccaggcuaguggccguaucacugugagcaccaagagaucucaacagacaguaauuccaaacaucggguccaggccccggguucgcaauauaccuucaagaauuagcaucuacuggaccauugugaaaccaggagauauccugcuaaucaacaguacggguaaucucauugccccgaggggcuacuucaagauacggucugggaaguccagcaucaugcgcucggacgcgcccauuggaaaauguaacucugaaugcaucacuccuaauggcuccauaccaaacgacaagcccuuucagaaugucaaccgaauuacauauggugcauguccuagauacgugaaacagaauacccugaaguuggccacugggaugaggaacgugccagagaaacaaacacggggaaucuucggcgcuaucgccggcuuuauugaaaaugggugggagggaauggucgaugguugguauggcuuccgucaccagaacucagaggggaucggacaggcagcugaccugaagaguacccaagccgcgauuaaucagauaaacggcaaauugaaccgccucaucgguaagacgaaugaaaaguuccaccagauugagaaagaauuuagcgagguugaagggagaauccaggaucuggagaaguacguggaggacaccaaaaucgauuuaugguccuauaacgccgaacugcucguagcacuugagaaucaacauacaauugaccugacugauucugaaaugaacaaguuguucgagaggaccaaaaagcagcuacgggaaaaugcugaggacaugggcaacggaugcuuuaagauauaccacaaaugugauaaugccugcaucggcagcauucgaaacgggacauaugaccaugauguguaccgcgacgaggcucugaauaacagauuccagaucaagggagucgaacucaaaucagguuacaaggacuggauucuguggaucaguuuugccauauccugcuuccuucugugugugguuuugcucggcuuuaucaugugggcaugccagaaagggaauauuagguguaacaucugcauuuga

SEQ ID NO: 128756 - RNA, 1701 nt, Artificial Sequence
  derived and/or modified sequence opt3 from hemagglutinin__InfluenzaA__AEG64999
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacagguggcauuugcgacaguccacaccagauccuagauggggagaacuguacccucauagacgcucugcuuggagauccgcagugcgacggcuuucagaauaaaaagugggaucuguucguggaaagaagcaaagccuauuccaacuguuaccccuaugacgucccugauuacgugucuuugaggucgcucguugcaucaagcgguacucuggaguuuaauaacgaaaguuucaauuggacaggggugacccagaacggaacguccucugccugcaagcggcgcagcaauaacuccuuuuucucacgacugaauuggcucacucauuuaaaguuuaaauauccagcucugaacgucaccaugcccaacaaugagaaguucgacaaacuuuacaucuggggcgugcaccauccuggcacagauaacgaccagauuaguuuguaugcacaggccagcgggcguaucacuguaucuaccaagagaucccaacagacaguuauuccaaauaucggaucaaggccccgggugcgcgauauaccuagcagaauuaguaucuacuggaccauugucaaaccaggugacauccugcuaaucaacucuacgggcaaucucauugcuccgaggggguacuuuaagauacgguccggaaagagcucgaucaugcgcucugacgcccccauuggcaaauguaacuccgagugcaucacuccuaaugguucaauaccaaacgauaagcccuuccagaaugugaaccgaauuacauauggggcguguccuagauacgugaaacagaauacccugaagcuggcaacuggaaugaggaacgucccagaaaaacaaacacggggcaucuuuggcgccaucgcuggguucauugagaauggaugggaagguaugguugacggcugguauggguuucgucaccagaacagugagggaaucggccaggccgcagaucuuaagagcacccaagcugccauuaaucagauaaacgguaaauugaaccgccucaucgggaagacgaaugagaaguuccaccagauugaaaaagaguucuccgaaguggagggcagaauccaggaccuggaaaaguacguagaggauaccaaaaucgacuuauggucuuauaacgcggagcugcucguggcccuugaaaaucaacauacaauugaucugacugacagcgagaugaacaaguuguuugaaaggaccaaaaagcagcuacgggagaaugcagaagauaugggaaacggcugcuucaagauauaccacaaaugugacaaugcuugcaucgggucaauucgaaacggaacauaugaucaugacgucuaccgcgacgaggcccugaauaacagauuucagaucaaggguguggagcucaaaaguggcuacaaggauuggauucuguggaucuccuucgcuauaagcugcuuucuucuguguguugccuugcucggguucaucaugugggcaugccagaaaggaaauauuagguguaacaucugcauuuga

SEQ ID NO: 128757 - RNA, 1701 nt, Artificial Sequence; identical to SEQ ID NO: 122271
  derived and/or modified sequence opt3 from hemagglutinin__InfluenzaA__AEG65010

SEQ ID NO: 128758 - RNA, 1701 nt, Artificial Sequence
  derived and/or modified sequence opt3 from hemagglutinin__InfluenzaA__AEG65021
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucauuuaaaguuuaaauauccagcucugaaugucaccaugcccaacacagagaaguucgacaaacuuuacaucuggggcgugcaccauccuggcacugauaacgaccagauuagcuuguaugcacaggccucugggcguaucaccguauccacaaagagaucacaacagaccguuauuccaaauaucggaagcaggccccgggugcgcgauauaccuaguagaauuucuaucuacuggacgauugucaaaccaggugacauccugcuaaucaacuccacuggcaaucucauugcuccgaggggguacuuuaagauacggagcggaaagucgucuaucaugcgcuccgacgcccccauuggcaaauguaacucagagugcaucacaccuaaugguaguauaccaaacgauaagcccuuccagaaugugaaccgaauuaccuauggggcguguccuagauacgugaaacagaauacucugaaacuugcaacaggaaugaggaacgucccagaaaaacaaacccggggcaucuuuggcgccaucgcuggguucauugagaauggaugggaagguaugguugacggcugguauggguuucgucaccagaacagcgagggaaucggccaggccgcagaucugaaguccacgcaagcugccauuaaucagauaaacgguaaauugaaucgccucaucgggaagaccaacgagaaguuccaccagauugaaaaagaguucucugaaguggagggcagaauccaggaccuggaaaaguacguagaggauacaaaaaucgacuuauggagcuauaacgcggagcugcucguggcccuugaaaaucaacauacuauugaucugaccgacucagagaugaacaaguuguuugaaaggacaaagaagcagcuacgggagaaugcagaagauaugggaaacggcugcuucaagauauaccacaaaugugacaaugcuugcaucgggaguauucgaaacggaacuuaugaucaugacgucuaccgcgacgaggcccugaauaacagauuucagaucaaggguguggagcucaaauccggcuacaaggauuggauucuguggaucagcuucgcuauaucuugcuuucuucuguguguugccuugcucggguucaucaugugggcaugccagaaaggaaauauuagguguaacaucugcauuuga

SEQ ID NO: 128759 - RNA, 1701 nt, Artificial Sequence
  derived and/or modified sequence opt3 from hemagglutinin__InfluenzaA__AEG65032
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaacaagcucaucgggaagacgaaugagaaauuccaccagauugaaaaggaguuuuccgaaguugagggccgcauccaggaucuggaaaaauacguggaggacaccaagaucgauuuauggucuuauaacgccgagcugcucguagcacuugaaaaucaacauacaauugaccugacugauagcgagaugaacaaauuguucgaaagaaccaagaagcagcuaagggagaaugcugaagacaugggaaacggcugcuuuaaaauauaccacaagugugauaaugccugcaucgggucaauucggaacggaacauaugaccaugauguguaccgagacgaggcucugaauaaccgcuuccagaucaaaggugucgagcucaagaguggcuacaaagacuggauucuguggaucuccuuugccauaagcugcuuccuucuguguguggcauugcucggguuuaucaugugggccugccagaagggaaauauuagauguaacaucugcauuuga

SEQ ID NO: 128760 - RNA, 1701 nt, Artificial Sequence; identical to SEQ ID NO: 122646
  derived and/or modified sequence opt3 from hemagglutinin__InfluenzaA__AEG65043

SEQ ID NO: 128761 - RNA, 1701 nt, Artificial Sequence; identical to SEQ ID NO: 122646
  derived and/or modified sequence opt3 from hemagglutinin__InfluenzaA__AEG65054

SEQ ID NO: 128762 - RNA, 1701 nt, Artificial Sequence
  derived and/or modified sequence opt3 from hemagglutinin__InfluenzaA__AEG65065
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggagucgaacucaaaagugguuacaaggacugggugcuguggauuuccuuugccaucagcugcuuccuucuguguguuguguugcucggcuuuauaaugugggcaugccagaaagggaauaucagguguaacauuugcaucuga

SEQ ID NO: 128763 - RNA, 1701 nt, Artificial Sequence
  derived and/or modified sequence opt3 from hemagglutinin__InfluenzaA__AEG65076
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuacguuuuaaguauccagcacugaaugugaccaugcccaacaacgagaaauucgacaaguuguacaucuggggcguccaccauccuggcacagauaaugaccagauuuuucuuuaugcccaggcuagcgggagaaucacugugucuaccaaaaggucccaacagacaguaauuccaaacguuggaucacggccccgcgugagaaauaucccuagcaggauaaguauuuacuggaccaucgucaagccaggugauauucugcuaaucaacucuacgggcaaucucaucgccccgcggggguacuucaaaauucgcuccggaaagagcucgauaaugcgaucugacgcgcccaucggcaaguguaacuccgagugcauuacuccuaaugguucaaucccaaacgacaaacccuuucagaaugugaacagaauaacauauggggcauguccuagguacgugaagcagaauacccugaaacuugccacuggaaugcggaacgucccagaaaagcaaacacguggcauuuucggcgcuaucgccggguuuaucgagaauggaugggaagguaugguugauggcugguauggguuccgccaccagaacagugagggaaccggccaggcagcugaccugaaaagcacgcaagccgcgauuaaucagaucaacgguaaguugaacagacucauugggaaaaccaaugagaaguuccaccagauagaaaaggaguuuuccgaaguggagggcaggauccaggaucuggaaaaauacguagaggacacaaagauugauuuauggucuuauaacgccgagcugcucguggcacuugaaaaucaacauacuaucgaccugaccgauagcgagaugaacaaauuguucgaacggacaaagaaacagcuacgagagaaugcugaagacaugggaaacggcugcuuuaagaucuaccacaagugugauaaugccugcauugggucaauacgcaacggaacuuaugaccaugaugucuacagagacgaggcucugaauaacagguuccagaucaaagguguggagcucaagaguggcuacaaagacuggauucuguggaucuccuuugccauuagcugcuuccuucuguguguugcauugcucggguuuaucaugugggccugccagaagggaaauauacgguguaacaucugcauuuga

SEQ ID NO: 128764 - RNA, 1701 nt, Artificial Sequence
  derived and/or modified sequence opt3 from hemagglutinin__InfluenzaA__AEG65087
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagaucuuuuuguaugcccaggcuagcgggcguauuacugugucuaccaagagaucccaacagacaguaauuccaaauaucggaucaaggccccggguucgcaacauaccuagcagaauuaguaucuacuggaccauugugaaaccaggugacauccugcuaaucaauucuacgggcaaccucauugccccgaggggguacuucaagauacgguccggaaagagcucgaucaugcgcucugaugcgcccauuggcaaauguaauuccgagugcaucacuccuaacgguucaauaccaaaugacaagcccuuucagaacgucaaucgaauuacauauggggcauguccuagauacgugaaacagaacacccugaagcuggccacuggaaugaggaaugugccagaaaaacaaacacggggcaucuucggcgcuaucgccggguuuauugagaacggaugggaagguauggucgacggcugguauggguuccgucaccagaauagugagggaaucggccaggcagcugaucuuaagagcacccaagccgcgauuaaccagauaaacgguaaauugaaucgccucaucgggaagacgaacgagaaguuccaccagauugaaaaagaguuuuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguucgaaaggaccaaaaagcagcuacgggagaacgcugaagauaugggaaauggcugcuuuaagauauaccacaaaugugacaacgccugcaucgggucaauucgaaauggaacauaugaucaugacguguaccgcgaugaggcucugaacaauagauuccagaucaagggugucgagcucaaaaguggcuacaaggacuggauucuguggaucuccuuugccauaagcugcuuccuucuguguguggcauugcucggguuuaucaugugggccugccagaaaggaaacauuagguguaauaucugcauuuga

SEQ ID NO: 128765 - RNA, 1701 nt, Artificial Sequence
  derived and/or modified sequence opt3 from hemagglutinin__InfluenzaA__AEG65098
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacgauuuucaaaacaaaaagugggaccuguucguggagagauccaaagccuauucuaauuguuaccccuaugaugucccugacuacgcaucguugaggucacucguggccagcaguggaacucuggaauuuaacaaugaguccuucaacuggacaggcguuacccagaaugguacgucuagcgcuugcaagcggcgcuccaacaauucauuuuucagucgacugaacuggcucacucauagcaaguuuaaauauccagcauuaaaugugaccaugcccaacaacgagaaguucgauaaacuguacaucuggggaguccaccauccugggacagacaaugaucagauuuuucuuuaugcccaggcuucuggccguaucacuguguccaccaagagaucacaacagacaguaauuccaaacaucggcagcaggccccggguucgcaauauaccuaguagaauuucuaucuacuggaccauugugaaaccaggggacaucuugcugaucaacuccacgggaaaucuaauugccccgagggguuacuucaagauacggagcggcaagucgucuaucaugcgcuccgacgcgcccauugggaaauguaacucagaaugcaucacuccuaauggaaguauaccaaacgauaagcccuuucagaaugucaaccgaauuacauauggcgcauguccuagauacgugaaacagaauacccucaagcuggccacugguaugaggaacgugccagagaaacaaacacgggggaucuucggagcuaucgccggcuuuauugaaaauggcugggaggggauggucgacggaugguaugguuuccgucaccagaacagcgagggcaucgggcaggcagcugaucuuaaguccacccaagccgcgauuaaucagauaaacggaaaccugaaucgcuugaucggcaaaacgaacgaaaaguuccaccagauugagaaggaauuuucugagguugaagguagaauccaggaccucgagaaauacguggaggauaccaagaucgaccuguggagcuauaaugccgaauuacugguagcacucgagaaccaacauacaauugaucuuacugacucagaaaugaauaaacuguucgagaggaccaagaaacaguugcgggaaaacgcugaggauauggggaauggcugcuuuaagauauaccacaagugugacaacgccugcaucggaaguauucgaaauggcacauaugaucaugacguguaccgcgacgaggcucuaaacaauagauuccagaucaaaggggucgaacugaaguccggauacaaagauuggauucucuggaucagcuuugccauaucuugcuuccugcuuugugugguucuguuggguuuuaucaugugggcaugccagaagggcaacauuagguguaauaucugcauuuga

SEQ ID NO: 128766 - RNA, 1701 nt, Artificial Sequence
  derived and/or modified sequence opt3 from hemagglutinin__InfluenzaA__AEG65109
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguaaacucauagacgcucugcuuggggauccgcagugcgacggauuucaaaacaagaaaugggaucuguucguggagagauccaaggccuauucuaauuguuaccccuaugacgucccugauuacgcaucguugaggucacucguggccagcaguggcacccuggaauuuaacaaugaguccuucaacuggacugguguuacacagaaugggaccucuagcgcuugcaagcggcgcuccaacaauucauuuuucagucgacugaacuggcucacgcauuuaaaauuuaaguauccagcacugaaugugacuaugcccaacaacgagaaauucgacaaguuguacaucuggggaguccaccauccuggcaccgauaaugaccagauuuuucuuuaugcccagagcucuggccguaucacaguguccacuaaaagaucacaacagaccguaauuccaaacaucgggagcaggccccggguucgcaauauaccuaguagaauuucuaucuacuggacaauugugaagccaggagauauccugcuaaucaacuccaccgguaaucucauugcuccgaggggcuacuucaagauacggagcgggaaaucgucuaucaugcgcuccgacgcccccauuggaaaguguaacucagaaugcaucacgccuaauggcaguauaccaaacgacaaacccuuucagaaugucaaccgaauuacuuauggugcguguccuagauacgugaagcagaauacacugaaacuugcaaccgggaugaggaacgugccagagaagcaaacucggggaaucuucggcgccaucgcuggcuuuauugaaaaugggugggagggaauggucgaugguugguauggcuuccgucaccagaacagcgaggggaucggacaggccgcagaccugaaauccacacaagcugccauuaaucagauaaacggcaaguugaaccgccucaucgguaagaccaaugaaaaauuccaccagauugagaaggaauuuucugagguugaagggagaauccaggaucuggagaaauacguggaggacacgaagaucgauuuauggagcuauaacgcggaacugcucguagcccuugagaaucaacauaccauugaccugacagauucagaaaugaacaaauuguucgagaggacuaagaagcagcuacgggaaaaugcagaggacaugggcaacggaugcuuuaaaauauaccacaagugugauaaugcuugcaucggcaguauucgaaacgggaccuaugaccaugauguguaccgcgacgaggcccugaauaacagauuccagaucaaaggagucgaacucaaguccgguuacaaagacuggauucuguggaucagcuuugcuauaucuugcuuccuucuguguguggccuugcucggcuuuaucaugugggcaugccagaaggggaauauuagguguaacaucugcauuuga

SEQ ID NO: 128767 - RNA, 1701 nt, Artificial Sequence
  derived and/or modified sequence opt3 from hemagglutinin__InfluenzaA__AEG65120
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauugcauauggugccuguccuagauacgugaaacagaauacacugaagcuggcuaccgggaugaggaacgugccagagaaacaaacucggggaaucuucggcgccaucgcaggcuuuauugaaaaugggugggagggaauggucgaugguugguauggcuuccgucaccagaacagugaggggaucggacaggcugccgaccuuaagagcacacaagcggccauuaaucagauaaacggcaaauugaaccgccucaucgguaagaccaaugaaaaguuccaccagauugagaaagaauuuuccgagguugaagggagaauccaggaucuggagaaguacguggaggacacgaaaaucgauuuauggucuuauaacgcagaacugcucguagcucuugagaaucaacauaccauugaccugacagauagcgaaaugaacaaguuguucgagaggacuaaaaagcagcuacgggaaaaugccgaggacaugggcaacggaugcuuuaagauauaccacaaaugugauaaugcuugcaucggcucaauucgaaacgggaccuaugaccaugauguguaccgcgacgaggcccugaauaacagauuccagaucaagggagucgaacucaaaagugguuacaaggacuggauucuguggaucuccuuugcaauaagcugcuuccuucugugugugguuuugcucggcuuuaucaugugggccugccagaaagggaauauuagguguaacaucugcauuuga

SEQ ID NO: 128768 - RNA, 1701 nt, Artificial Sequence
  derived and/or modified sequence opt3 from hemagglutinin__InfluenzaA__AEG65131
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauagcaaguuuaaauauccagcauuaaaugugaccaugcccaacaacgagaaguucgacaaacuguacaucuggggaguccaccauccuggcacagauaaugaccagauuuuucuuuaugcccaggcuucuggccguaucacuguguccaccaagagaucacaacagacaguaauuccaaacaucgggagcaggccccggguucgcaauauaccuaguagaauuucuaucuacuggaccauugugaaaccaggagauaucuugcugaucaacuccacggguaaucuaauugccccgaggggcuacuucaagauacggagcgggaagucgucuaucaugcgcuccgacgcgcccauuggaaaauguaacucagaaugcaucacuccuaauggcaguauaccaaacgacaagcccuuucagaaugucaaccgaauuacauauggugcauguccuagauacgugaaacagaauacccucaagcuggccacugggaugaggaacgugccagagaaacaaacacggggaaucuucggcgcuaucgccggcuuuauugaaaaugggugggagggaauggucgaugguugguauggcuuccgucaccagaacagcgaggggaucggacaggcagcugaccuuaaguccacccaagccgcgauuaaucagauaaacggcaaacugaaccgcuugaucgguaagacgaaugaaaaguuccaccagauugagaaagaauuuucugagguugaagggagaauccaggaucucgagaaguacguggaggacaccaaaaucgaucuguggagcuauaacgccgaauuacugguagcacucgagaaucaacauacaauugaccuuacugauucagaaaugaacaagcuguucgagaggaccaaaaagcaguugcgggaaaaugcugaggacaugggcaacggaugcuuuaagauauaccacaaaugugauaaugccugcaucggcaguauucgaaacgggacauaugaccaugauguguaccgcgacgaggcucuaaauaacagauuccagaucaagggagucgaacugaaauccgguuacaaggacuggauucucuggaucagcuuugccauaucuugcuuccugcuuugugugguucuguugggcuuuaucaugugggcaugccagaaagggaauauuagguguaacaucugcauuuga

SEQ ID NO: 128769 - RNA, 1701 nt, Artificial Sequence; identical to SEQ ID NO: 122067
  derived and/or modified sequence opt3 from hemagglutinin__InfluenzaA__AEG65142

SEQ ID NO: 128770 - RNA, 1701 nt, Artificial Sequence; identical to SEQ ID NO: 122067
  derived and/or modified sequence opt3 from hemagglutinin__InfluenzaA__AEG65153

SEQ ID NO: 128771 - RNA, 1701 nt, Artificial Sequence
  derived and/or modified sequence opt3 from hemagglutinin__InfluenzaA__AEG65164
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggaguuccucgucgcccuugaaaaccaacacaccaucgaucugacagacuccgagaugaacaaguuguuugaaagaacuaaaaagcagcuacgggagaaugcagaggauaugggcaacggaugcuucaagauuuaucauaaaugugacaaugcuugcaucggcagcauccgaaacgggaccuacgaucacgacguguaccgcgacgaagcccugaauaacagauuucagauuaagggaguugagcucaaaucugguuauaaggauuggauacuguggaucucauucgcuauuaguugcuuucuucuguguaucguguugcucggcuucauuaugugggccugccagaaagggaauaucagguguaacauaugcaucuga

SEQ ID NO: 128772 - RNA, 1701 nt, Artificial Sequence
  derived and/or modified sequence opt3 from hemagglutinin__InfluenzaA__AEG65175
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcgagcggcgcuccaacaagucauuuuucagucgacugaauuggcucacucauuuaaaguauaaauacccagcacugaacgugaccaugcccaauaacgagaaguuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaaaccuggugacauucugcuaaucaauucgacgggcaaccucaucgccccaaggggguauuucaagauucggaauggaaagucuuccauaaugcgcucagacgcgccgaucggcaaauguaacagugaaugcauuacucccaaugguagcaucccuaacgauaagccauuucagaaugugaaccgaauaacauacggggcaugucccagauaugugaaacagaauacccugaaacuugccacuggaaugaggaacgucccugagaaacaaacacggggcauuuucggcgcuaucgccggguuuaucgaaaauggaugggaggguaugguugacggcugguacggguuccgucaccagaacuccgagggaaccggccaggcagcugaucugaagucuacgcaagccgcgauuaaucagaucaacgguaaauugaaucgccucauugggaagaccaacgaaaaguuucaccagauagagaaagaguucagcgaaguggaaggcagaauccaggaccuggagaaguauguagaggauacaaaaauugacuuauggucauacaacgccgaacugcucguggcacuugagaaucaacauacuaucgaucugaccgacagugaaaugaacaaguuguucgagaggacaaagaagcagcuacgggaaaaugcugaggauaugggaaacggcugcuuuaagaucuaucacaaaugugacaaugccugcauuggguccauacgaaacggaacuuacgaucaugacgucuaccgcgacgaggcucugaauaacagauuccagaucaaggguguggaacucaaaagcggcuauaaggauuggauucuguggaucucuuuugccauuucaugcuuccuucuguguguugcauugcucggguuuaucaugugggccugccagaaaggaaauauaaggugugacaucugcauuuga

SEQ ID NO: 128773 - RNA, 1701 nt, Artificial Sequence; identical to SEQ ID NO: 122435
  derived and/or modified sequence opt3 from hemagglutinin__InfluenzaA__AEG65186

SEQ ID NO: 128774 - RNA, 1701 nt, Artificial Sequence
  derived and/or modified sequence opt3 from hemagglutinin__InfluenzaA__AEG65197
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaccaacagguggcauuugcgacaguccgcaccagauccuagauggggagaauuguacccucauagacgcucugcuuggagauccccagugcgacggcuuucaaaacaaaaagugggaucuguucguggaaagaagcaaagccuauuccaauuguuacccuuaugacgucccagauuacgcaucuuugaggucgcucguggccucaagcgguacucuggaguuuaacaaugaaaguuucaacuggacagggguuacccagaauggaacguccucugcuugcaagcggcgcagcaacaauuccuuuuucucacgacugaacuggcucacucauuuaaaguuuaaauaucccgcacugaaugugaccaugccuaacaacgagaaguucgacaaacuuuacaucuggggcguccaccauccaggcacagauaaugaccagauuaguuuguaugcccaggcuagcgggcguaucacugugucuaccaagagaucccaacagacaguaauucccaacaucggaucaaggccucggguucgcgauauaccaagcagaauuaguaucuacuggaccauugugaaaccgggugacaucauccugauuaauucuacgggcaaccuaauagcccccaggggguacuuuaagauccgguccggaaagagcucgauuaugcgcucugacacuccuaucggcaaauguaauuccgagugcauaacaccaaacgguucaauucccaaugauaagccuuuccagaacgucaaucgaaucaccuauggggcguguccaagauacgugaaacagaacacucucaagcuggcaacaggaaugaggaaugugcccgaaaaacaaacccggggcaucuuuggcgccauugcuggguucaucgagaacggaugggaagguauggucgacggcugguauggguuucgucaccagaauagugagggaauuggccaggccgcagaucuuaagagcacgcaagcugccauaaaccagaucaaugguaaacugaaccgcuugauugggaagaccaacgagaaguuccaccagaucgaaaaagaguucuccgaaguugagggcagaauccaggaccucgaaaaguacguggaggauacaaaaauugaccuguggucuuauaaugcggaguuacugguagcccucgaaaaccaacauacuauagaucuuaccgacagcgagaugaauaagcuguuugaaaggacuaaaaagcaguugcgggagaacgcagaagauaugggaaauggcugcuucaagaucuaccacaaaugugacaacgcuugcauugggucaauccgaaauggaacauaugaucaugacguguaccgcgacgaggcccuaaacaauagauuucagauuaagggugucgagcugaaaaguggcuacaaggauuggauccucuggauauccuucgcuaucagcugcuuucugcuuuguguggcccuguugggguucauuaugugggcaugccagaaaggaaacaucagguguaauauuugcaucuga

SEQ ID NO: 128775 - RNA, 1701 nt, Artificial Sequence; identical to SEQ ID NO: 122646
  derived and/or modified sequence opt3 from hemagglutinin__InfluenzaA__AEG65208

SEQ ID NO: 128776 - RNA, 1701 nt, Artificial Sequence
  derived and/or modified sequence opt3 from hemagglutinin__InfluenzaA__AEG65219
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaagcagaauacccugaaacuugccacuggaaugaggaacgucccagaaaagcaaacacggggcauuuuuggcgcuaucgccggguucaucgagaauggaugggaagguaugguugacggcugguauggguuucgucaccagaacagcgagggaaccggccaggcagcugaucugaaauccacgcaagccgcgauuaaucagaucaacgguaaguugaaucgccucauugggaagaccaacgagaaauuccaccagauagaaaaggaguucucugaaguggagggcagaauccaggaccuggaaaaauacguagaggauacaaagauugacuuauggagcuauaacgccgagcugcucguggcacuugaaaaucaacauacuaucgaucugaccgacucagagaugaacaaauuguuugaaaggacaaagaagcagcuacgggagaaugcugaagauaugggaaacggcugcuucaaaaucuaccacaagugugacaaugccugcauugggaguauacgaaacggaacuuaugaucaugacgucuaccgcgacgaggcucugaauaacagauuucagaucaaagguguggagcucaaguccggcuacaaagauuggauucuguggaucagcuucgccauuucuugcuuucuucuguguguugcauugcucggguucaucaugugggccugccagaagggaaauauaaaguguaacaucugcauuuga

SEQ ID NO: 128777 - RNA, 1701 nt, Artificial Sequence; identical to SEQ ID NO: 123811
  derived and/or modified sequence opt3 from hemagglutinin__InfluenzaA__AEG65230

SEQ ID NO: 128778 - RNA, 1701 nt, Artificial Sequence; identical to SEQ ID NO: 123811
  derived and/or modified sequence opt3 from hemagglutinin__InfluenzaA__AEG65252

SEQ ID NO: 128779 - RNA, 1701 nt, Artificial Sequence; identical to SEQ ID NO: 122532
  derived and/or modified sequence opt3 from hemagglutinin__InfluenzaA__AEG65263

SEQ ID NO: 128780 - RNA, 1701 nt, Artificial Sequence; identical to SEQ ID NO: 122532
  derived and/or modified sequence opt3 from hemagglutinin__InfluenzaA__AEG65274

SEQ ID NO: 128781 - RNA, 1701 nt, Artificial Sequence; identical to SEQ ID NO: 122532
  derived and/or modified sequence opt3 from hemagglutinin__InfluenzaA__AEG65285

SEQ ID NO: 128782 - RNA, 1701 nt, Artificial Sequence
  derived and/or modified sequence opt3 from hemagglutinin__InfluenzaA__AEG65296
augaagaccgugaucgcccugagcuacauucucugccuugucuucgcucagaaacugcccggcaacgacaauuccacagcaacuuuguguuuagggcaccaugccguuccuaacggaacgauagugaagaccaucacaaaugaucaaauugagguaacuaacgcgaccgaacuggugcagucuucaaguacagguggcaucugcgacagcccacaccagauucuagauggggagaauuguacccucaucgacgcucugcuuggagauccgcagugcgacggcuuucaaaacaaaaagugggaucuguucgucgaaagauccaaagccuauucuaauuguuaccccuaugacgugccugaucaugcaucguugaggucacucguugccagcagugguacucuggaguuuaacaaugaauccuucgacuggacaggggugacccagaacggaacgucuagcgcuugcaagcggcgcuccaauaagucauuuuucagucgacugaacuggcucacucacuuaaaauacaaguauccagcacugaaugucaccaugcccaacaaugagaaauuugauaaacuuuacauauggggcgugcaucacccuggcacagacagcgaucagaucucuuuguaugcccaggcuuccgggcguauuacuguaucaaccaagagaagccaacagacaguuaucccaaacauuggaaguaggccccgggugcgcgacgucucuuccagaaucagcauauacuggaccauugugaagccuggugacauccugcuaauuaacucgacgggcaaucucaucgccccaaggggguacuucaagauccggucuggaaaauccucaauuaugcgcagugaugcgccgauaggcaaguguaacagcgagugcaucacucccaaugguuccauuccuaacgacaaaccauuucagaaugugaaccgaaucacauauggggcaugucccagauacgucaagcagaauacccugaaacuugccacuggaaugaggaacguuccugaaaagcaaacacggggcauauucggcgcuauugccggguuuaucgagaauggaugggaagguaugguggauggcugguauggguuccgucaccagaacucugagggaaccggccaggcagcugaccugaaaagcacgcaagccgcgaucaaucagauuaacgguaaguugaaucgccucaucgggaagaccaacgagaaauuucaucagauugaaaaggaguucucagaaguagagggcagaauacaggaucuggaaaaauacguggaggacacaaagaucgauuuauggaguuauaaugccgagcugcucgucgcacuugaaaaccaacacacuauugaccugaccgauuccgagaugaacaaauuguucgaaaggacaaagaagcagcuacgggagaaugcugaagacaugggaaacggcugcuuuaaaaucuaccauaagugugauaaugccugcaucgggagcauucgaaacggaacuuaugaccacgacguguaccgcgaugaggcucugaauaacagauuccagauaaaagguguugagcucaagucuggcuacaaagacuggauccuguggauuucauuugccaucaguugcuuccuucuguguguggcauugcucggguuuauuaugugggccugccagaagggaaauaucagguguaacauaugcaucuga

SEQ ID NO: 128783 - RNA, 1701 nt, Artificial Sequence; identical to SEQ ID NO: 123811
  derived and/or modified sequence opt3 from hemagglutinin__InfluenzaA__AEG65307

SEQ ID NO: 128784 - RNA, 1701 nt, Artificial Sequence
  derived and/or modified sequence opt3 from hemagglutinin__InfluenzaA__AEG65318
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaaaagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaggcagaauacccugaaacuugccacuggaaugcggaacgucccagaaaagcaaacacguggcauuuuuggcgcuaucgccggguucaucgagaauggaugggaagguaugguugacggcugguauggguuucgccaccagaacagcgagggaaccggccaggcagcugaucugaaguccacgcaagccgcgauuaaucagaucaacgguaaauugaauagacucauugggaagaccaacgagaaguuccaccagauagaaaaagaguucucugaaguggagggcaggauccaggaccuggaaaaguacguagaggauacaaaaauugacuuauggagcuauaacgccgagcugcucguggcacuugaaaaucaacauacuaucgaucugaccgacucagagaugaacaaguuguuugaacggacaaagaagcagcuacgagagaaugcugaagauaugggaaacggcugcuucaagaucuaccacaaaugugacaaugccugcauugggaguauacgcaacggaacuuaugaucaugacgucuacagagacgaggcucugaauaacagguuucagaucaaggguguggagcucaaauccggcuacaaggauuggauucuguggaucagcuucgccauuucuugcuuucuucuguguguugcauugcucggguucaucaugugggccugccagaaaggaaauauacgguguaacaucugcauuuga

SEQ ID NO: 128785 - RNA, 1701 nt, Artificial Sequence; identical to SEQ ID NO: 123811
  derived and/or modified sequence opt3 from hemagglutinin__InfluenzaA__AEG65329

SEQ ID NO: 128786 - RNA, 1701 nt, Artificial Sequence
  derived and/or modified sequence opt3 from hemagglutinin__InfluenzaA__AEG65340
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcgagcggcgcuccaacaagucauuuuucagucgacugaauuggcucacucauuuaaaguauaaauacccagcacugaacgugaccaugcccaauaacgagaaguuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaaaccuggugacauucugcuaaucaauucgacgggcaaccucaucgccccaaggggguauuucaagauucggucuggaaaguccucaauaaugcgcagugacgcgccgaucggcaaauguaauagcgaaugcauuacucccaacgguuccaucccuaaugauaagccauuucagaacgugaaucgaauaacauacggggcaugucccagauaugugaaacagaacacccugaaacuugccacuggaaugaggaaugucccugagaaacaaacacggggcauuuucggcgcuaucgccggguuuaucgaaaacggaugggaggguaugguugacggcugguacggguuccgucaccagaauagcgagggaaccggccaggcagcugaucugaagucuacgcaagccgcgauuaaccagaucaaugguaaauugaaccgccucauugggaagaccaaugaaaaguuucaccagauagagaaagaguucucagaaguggaaggcagaauccaggaccuggagaaguauguagaggauacaaaaauugacuuauggaguuacaacgccgaacugcucguggcacuugagaaccaacauacuaucgaucugaccgacuccgaaaugaauaaguuguucgagaggacaaagaagcagcuacgggaaaacgcugaggauaugggaaauggcugcuuuaagaucuaucacaaaugugacaacgccugcauugagagcauacgaaaugggacuuacgaucaugacgucuaccgcgacgaagcucugaacaauagauuccagaucaagggaguggagcucaaaucugguuauaaggauuggauucuguggaucucauuugccauuaguugcuuccuucuguguguugcauugcucggcuuuaucaugugggccugccagaaagggaacauaagguguaauaucugcauuuga

SEQ ID NO: 128787 - RNA, 1701 nt, Artificial Sequence; identical to SEQ ID NO: 123811
  derived and/or modified sequence opt3 from hemagglutinin__InfluenzaA__AEG65351

SEQ ID NO: 128788 - RNA, 1701 nt, Artificial Sequence; identical to SEQ ID NO: 123811
  derived and/or modified sequence opt3 from hemagglutinin__InfluenzaA__AEG65362

SEQ ID NO: 128789 - RNA, 1701 nt, Artificial Sequence; identical to SEQ ID NO: 128786
  derived and/or modified sequence opt3 from hemagglutinin__InfluenzaA__AEG65373

SEQ ID NO: 128790 - RNA, 1701 nt, Artificial Sequence; identical to SEQ ID NO: 122532
  derived and/or modified sequence opt3 from hemagglutinin__InfluenzaA__AEG65384

SEQ ID NO: 128791 - RNA, 1701 nt, Artificial Sequence; identical to SEQ ID NO: 122532
  derived and/or modified sequence opt3 from hemagglutinin__InfluenzaA__AEG65406

SEQ ID NO: 128792 - RNA, 1701 nt, Artificial Sequence; identical to SEQ ID NO: 122532
  derived and/or modified sequence opt3 from hemagglutinin__InfluenzaA__AEG65417

SEQ ID NO: 128793 - RNA, 1701 nt, Artificial Sequence; identical to SEQ ID NO: 122532
  derived and/or modified sequence opt3 from hemagglutinin__InfluenzaA__AEG65428

SEQ ID NO: 128794 - RNA, 1701 nt, Artificial Sequence
  derived and/or modified sequence opt3 from hemagglutinin__InfluenzaA__AEG65439
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaguuggccaggcagcugaccuuaagagcacccaagccgcgaucaaucagauuaacgguaaauugaaccgccucauagggaagacgaaugagaaguuccaccagaucgaaaaagaguuuuccgaaguggagggcaggauucaggaucuggaaaaguacguagaggacaccaaaaucgauuuauggucuuauaacgccgagcugcucguggcacuugaaaaucaacauacaaucgaccugacugauagcgagaugaacaaguuguucgaaagaaccaaaaagcagcuacgggagaaugcugaagacaugggaaacggcugcuuuaagauuuaccacaaaugugauaaugccugcauagggucaauccgaaacggaacauaugaccaugaugucuaccgcgacgaggcucugaauaacagauuccagauuaaggguguggagcucaaaaguggcuacaaggacuggauccuguggauuuccuuugccaucagcugcuuccuucuguguguugcauugcucggguuuauaaugugggccugccagaaaggaaauaucagguguaacauuugcaucuga

SEQ ID NO: 128795 - RNA, 1701 nt, Artificial Sequence
  derived and/or modified sequence opt3 from hemagglutinin__InfluenzaA__AEG65450
augaagaccaucauugccuggagcuacauacugugccucguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuucaaaacaaaaagugggaucuuuucguggaaagauccaaagccuauucuaauuguuaccccuaugacgucccugauuacgcaucgcugaggucauugaucgccagcagugguacucucgaguuuaacaaugaauccuucaacuggacaggggugacccagaauggaacgucuagcgcuugcaagcggcgcuccaacucaaguuucuucagccgacugaauuggcugacucaucucaaguuuaaauauccagcauuaaacguuaccaugcccaauaacgaggaguucgacaagcuguacauuuggggcgugcaccauccuggcacauauaacgaucagaucucucuuuacgcccaggcuuccgggcguauuacugucucaaccaaaagaagccaacagacagugaucccaaauauaggaaguaggccccggguacgcgacauuccuucuagaaucuccauuuacuggaccaucguuaagccaggugauaucuugcugauuaacagcacgggcaaucuaauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccucaaacuggccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccuuaaaucuacccaagccgcgauagaucagaucaaugguaagcugaaccgcuugauugggaaaacgaaugaaaaguuccaccagaucgagaaggaauuuagcgaggucgaaggcagaauccaggaccucgagaaauauguugaggauaccaagauugaccuguggucauacaacgccgaauuacugguggcacucgagaaccaacauacaauagaucuuacugacagugaaaugaauaaacuguuugagaggaccaagaaacaguugcgggaaaacgcugaggauaugggaaauggcugcuucaagaucuaucacaagugugacaacgccugcauuggguccauccgaaauggaacauacgaucaugacguauaccgcgacgaggcucuaaacaauagauuucagauuaaagguguggaacucaagagcggcuauaaagauuggauccuguggauaucuuucgccaucucaugcuuucugcuuugugucgcacuguugggguucauuaugugggccugccagaagggaaacaucagguguaauauuugcaucuga

SEQ ID NO: 128796 - RNA, 1701 nt, Artificial Sequence; identical to SEQ ID NO: 128795
  derived and/or modified sequence opt3 from hemagglutinin__InfluenzaA__AEG65461

SEQ ID NO: 128797 - RNA, 1701 nt, Artificial Sequence
  derived and/or modified sequence opt3 from hemagglutinin__InfluenzaA__AEG65472
augaagaccaucauugccuggagcuacauacugugccucguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuucaaaacaaaaagugggaucuuuucguggaaagauccaaagccuauucuaauuguuaccccuaugacgucccugauuacgcaucgcugaggucauugaucgccagcagugguacucucgaguuuaacaaugaauccuucaacuggacaggggugacccagaauggaacgucuagcgcuugcaagcggcgcuccaacucaaguuucuucagccgacugaauuggcugacucaucucaaguuuaaauauccagcauuaaacguuaccaugcccaauaacgaggaguucgacaagcuguacauuuggggcgugcaccauccuggcacauauaacgaucagaucucucuuuacgcccaggcuuccgggcguauuacugucucaaccaaaagaagccaacagacagugaucccaaauauaggaaguaggccccggguacgcgacauuccuucuagaaucuccauuuacuggaccaucguuaagccaggugauaucuugcugauuaacagcacgggcaaucuaauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccucaaacuggccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccuuaaaucuacccaagccgcgauagaucagaucaaugguaagcugaaccgcuugauugggaaaacgaaugaaaaguuccaccagaucgagaaggaauuuagcgaggucgaaggcagaauccaggaccucgagaaauauguugaggauaccaagauugaccuguggucauacaacgccgaauuacugguggcacucgagaaccaacauacaauagaucuuacugacagugaaaugaauaaacuguuugagaucaccaagaaacaguugagggaaaacgcugaggauaugggaaauggcugcuucaagauuuaucacaagugugacaacgccugcaucggguccauucggaauggaacauacgaucaugacguauaccgagacgaggcucuaaacaaucgcuuucagaucaaagguguggaacucaagagcggcuauaaagauuggauacuguggaucucuuucgccauuucaugcuuucugcuuugugucgcacuguugggguucaucaugugggccugccagaagggaaacauuagauguaauaucugcauauga

SEQ ID NO: 128798 - RNA, 1701 nt, Artificial Sequence; identical to SEQ ID NO: 128795
  derived and/or modified sequence opt3 from hemagglutinin__InfluenzaA__AEG65483

SEQ ID NO: 128799 - RNA, 1701 nt, Artificial Sequence; identical to SEQ ID NO: 128795
  derived and/or modified sequence opt3 from hemagglutinin__InfluenzaA__AEG65494

SEQ ID NO: 128800 - RNA, 1701 nt, Artificial Sequence; identical to SEQ ID NO: 128795
  derived and/or modified sequence opt3 from hemagglutinin__InfluenzaA__AEG65505

SEQ ID NO: 128801 - RNA, 1701 nt, Artificial Sequence; identical to SEQ ID NO: 128795
  derived and/or modified sequence opt3 from hemagglutinin__InfluenzaA__AEG65516

SEQ ID NO: 128802 - RNA, 1701 nt, Artificial Sequence; identical to SEQ ID NO: 128795
  derived and/or modified sequence opt3 from hemagglutinin__InfluenzaA__AEG65527

SEQ ID NO: 128803 - RNA, 1701 nt, Artificial Sequence; identical to SEQ ID NO: 128795
  derived and/or modified sequence opt3 from hemagglutinin__InfluenzaA__AEG65538

SEQ ID NO: 128804 - RNA, 1701 nt, Artificial Sequence
  derived and/or modified sequence opt3 from hemagglutinin__InfluenzaA__AEG65560
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugaagucagacgcgcccaucggcaaauguaacagugaaugcauaacuccuaaugguagcauuccaaacgacaagcccuuccagaaugugaaccgcaucacauacggggcauguccucgauaugucaaacagaauacccugaaacuugccacuggaaugagaaacgugccagagaagcaaacaaggggcaucuuuggcgcuauugccggguucaucgaaaauggaugggaggguaugguggauggcugguacggguuucggcaccagaacuccgagggaauuggccaggcagcugaccugaagucuacccaagccgcgauagaucagaucaaugguaaauugaaccgucucauugggaagacgaaugaaaaguuccaccagaucgagaaagaauuuagcgaggucgaaggccgcauccaggaccuggagaaguauguugaggauaccaaaauugacuuauggucauacaacgccgaacugcucguggcacuugagaaccaacauacaauagaucugacugacagugaaaugaauaaguuguuugagagaaccaaaaagcagcuaagggaaaacgcugaggauaugggaaauggcugcuucaagaucuaucacaaaugugacaacgccugcauuggguccauccggaauggaacauacgaucaugacguauaccgagacgaggcucugaacaaucgcuuucagauuaaggguguggaacucaaaagcggcuauaaggauuggauccuguggauaucuuucgccaucucaugcuuucuucugugugucgcauugcucggguucauuaugugggccugccagaaaggaaacaucagauguaauauuugcaucuga

SEQ ID NO: 128805 - RNA, 1701 nt, Artificial Sequence; identical to SEQ ID NO: 128804
  derived and/or modified sequence opt3 from hemagglutinin__InfluenzaA__AEG65571

SEQ ID NO: 128806 - RNA, 1701 nt, Artificial Sequence; identical to SEQ ID NO: 128804
  derived and/or modified sequence opt3 from hemagglutinin__InfluenzaA__AEG65582

SEQ ID NO: 128807 - RNA, 1701 nt, Artificial Sequence; identical to SEQ ID NO: 128804
  derived and/or modified sequence opt3 from hemagglutinin__InfluenzaA__AEG65593

SEQ ID NO: 128808 - RNA, 1701 nt, Artificial Sequence
  derived and/or modified sequence opt3 from hemagglutinin__InfluenzaA__AEG65604
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaaacuuuacauuuggggcgugcaccauccuggcacagauaaugaccagaucagcuuguaugcccaggcuucugggaagauuacugucuccaccaagcguucacaacagacagugaucccaaacauaggaagcagacccaggguacgggauauuccuagucgcaucucuauuuacuggaccaucguuaaaccaggugacauccugcuaauuaauuccacgggcaaccucauagccccgagaggguacuuuaagaucaggagcggaaagucgucuauuaugcgguccgacgcgcccaucggcaaauguaauucagaaugcauaacuccuaacgguaguauuccaaaugauaagcccuuccagaacgugaaucgcaucacauauggggcauguccucgauacgucaaacagaacacccugaaacuugccacuggaaugagaaaugugccagagaagcaaacaaggggcaucuuuggcgcuauugccggguucaucgaaaacggaugggaggguaugguggacggcugguauggguuucggcaccagaauagcgagggaauuggccaggcagcugaucugaaguccacccaagccgcgauagaccagaucaacgguaaauugaaucgucucauugggaagacgaacgaaaaguuccaccagaucgagaaagaguucucugaagucgaaggccgcauccaggaucuggagaaguacguugaggacaccaaaauugauuuauggagcuauaacgccgaacugcucguggcacuugagaaucaacauacaauagaccugacugauucagaaaugaacaaguuguuugagagaaccaaaaagcagcuaagggaaaaugcugaggacaugggaaacggcugcuucaagaucuaccacaaaugugauaaugccugcauugggaguauccggaacggaacauaugaccaugacguauaccgagaugaggcucugaauaaccgcuuucagauuaaggguguggaacucaaauccggcuacaaggacuggauccuguggaucagcuucgccauaucuugcuuucuucugugugucgcauugcucggguucauuaugugggccugccagaaaggaaauaucagauguaacauuugcaucuga

SEQ ID NO: 128809 - RNA, 1701 nt, Artificial Sequence
  derived and/or modified sequence opt3 from hemagglutinin__InfluenzaA__AEG65626
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaauucauuuuucagucgccugaacuggcucacucauuuaaaauuuaaguauccagcacugaaugugaccaugcccaacaacaaaaaguucgacaaacuuuacaucuggggcguccaccauccuggcacagauaaugaccagauuagcuuguaugcccaggcuucugggcgaaucacuguguccaccaagcguucacaacagacaguaauuccaaacaucggaagcagacccaggguucgggauauaccuagucgcauuucuaucuacuggaccauugugaagccaggugacaugcugcuaaucaauuccacgggcaaccucaucgccccgagaggguacuuuaaaauuaggagcggaaagucgucuauaaugcgguccgacgcgcccaucggcaaauguaauucagagugcauuacuccuaacgguaguaucccaaaugauaagcccuuccagaacgucaaucgcauaacauauggggcauguccucgauacgugaaacagaacacccugaaacuugccacuggaaugagaaaugugccagagaagcaaacaaggggcauuuuuggcgcuaucgccggguucaucgaaaacggaugggaggguauggucgacggcugguauggguuucggcaccagaauagcgaaggaaccggccaggcagcugaucugaaguccacgcaagccgcgauuaaccagaucaaugguaaguugaaccgucucauugggaaaaccaacgagaaguuccaccagauagagaaagaguucucugaaguugaaggccgcauccaggaccuggagaaguacguggaagauacaaaaauugacuuauggagcuauaaugccgagcugcucguagcacuugagaaccaacauacuaucgaucugaccgacucagaaaugaauaaguuguuugagagaacaaagaaacagcuaagggaaaacgcugaggauaugggaaauggcugcuucaagaucuaccacaaaugugacaacgccugcauugggaguauacggaauggaacuuaugaucaugacguguaccgagacgaagcucugaacaaucgcuuucagaucaagggugucgagcucaaauccggcuacaaggauuggauucuguggaucagcuucgccauuucuugcuuucuucuguguguggcauugcucggguucaucaugugggccugccagaagggaaacauaagauguaauaucugcauuuga

SEQ ID NO: 128810 - RNA, 1701 nt, Artificial Sequence
  derived and/or modified sequence opt3 from hemagglutinin__InfluenzaA__AEG65637
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaauucauuuuucagucgccugaacuggcucacucauuuaaaauuuaaguauccagcacugaaugugaccaugcccaacaacaaaaaguucgacaaacuuuacaucuggggcguccaccauccuggcacagauaaugaccagauuagcuuguaugcccaggcuucugggcgaaucacuguguccaccaagcguucacaacagacaguaauuccaaacaucggaagcagacccaggguucgggauauaccuagucgcauuucuaucuacuggaccauugugaagccaggugacaugcugcuaaucaauuccacgggcaaccucaucgccccgagaggguacuuuaaaauuaggagcggacggucgucuauaaugcgcuccgacgcgcccaucggcaaguguaauucagagugcauuacuccuaacgguaguaucccaaaugauaaacccuuccagaacgucaaucgaauaacauauggggcauguccuagauacgugaagcagaacacccugaaacuugccacuggaaugaggaaugugccagagaagcaaacacggggcauuuuuggcgcuaucgccggguucaucgaaaacggaugggaggguauggucgacggcugguauggguuucgucaccagaauagcgaaggaaccggccaggcagcugaucugaaauccacgcaagccgcgauuaaccagaucaaugguaaguugaaccgccucauugggaagaccaacgagaaauuccaccagauagagaaggaguucucugaaguugaaggcagaauccaggaccuggagaaauacguggaagauacaaagauugacuuauggagcuauaaugccgagcugcucguagcacuugagaaccaacauacuaucgaucugaccgacucagaaaugaauaaauuguuugagaggacaaagaagcagcuacgggaaaacgcugaggauaugggaaauggcugcuucaaaaucuaccacaagugugacaacgccugcauugggaguauacgaaauggaacuuaugaucaugacguguaccgcgacgaagcucugaacaauagauuucagaucaaaggugucgagcucaaguccggcuacaaagauuggauucuguggaucagcuucgccauuucuugcuuucuucuguguguggcauugcucggguucaucaugugggccugccagaagggaaacauaagguguaauaucugcauuuga

SEQ ID NO: 128811 - RNA, 1701 nt, Artificial Sequence; identical to SEQ ID NO: 122047
  derived and/or modified sequence opt3 from hemagglutinin__InfluenzaA__AEG65648

SEQ ID NO: 128812 - RNA, 1701 nt, Artificial Sequence; identical to SEQ ID NO: 123811
  derived and/or modified sequence opt3 from hemagglutinin__InfluenzaA__AEG65659

SEQ ID NO: 128813 - RNA, 1701 nt, Artificial Sequence; identical to SEQ ID NO: 123811
  derived and/or modified sequence opt3 from hemagglutinin__InfluenzaA__AEG65670

SEQ ID NO: 128814 - RNA, 1701 nt, Artificial Sequence; identical to SEQ ID NO: 123811
  derived and/or modified sequence opt3 from hemagglutinin__InfluenzaA__AEG65681

SEQ ID NO: 128815 - RNA, 1701 nt, Artificial Sequence; identical to SEQ ID NO: 128786
  derived and/or modified sequence opt3 from hemagglutinin__InfluenzaA__AEG65692

SEQ ID NO: 128816 - RNA, 1701 nt, Artificial Sequence; identical to SEQ ID NO: 122646
  derived and/or modified sequence opt3 from hemagglutinin__InfluenzaA__AEG65703

SEQ ID NO: 128817 - RNA, 1701 nt, Artificial Sequence
  derived and/or modified sequence opt3 from hemagglutinin__InfluenzaA__AEG65747
augaagaccaucauugcccugagcuacauacucugccuuguguucgcucagaaacugcccggcaacgacaauuccacagcaacuuuguguuuagggcaccauacggucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcaagcggcgcuccaacaauucauuuuucagucgacugaacuggcucacccauuuaaaguuuaaauauccagcucugaaugugacaaugcccaacaacgagaaguucgacaaacuuuacaucuggggaguccaccauccuggcacugauaaugaccagaucuuuuuguaugcacaggccagcggccguauuaccgugucuacaaagagaucccaacagaccguaauuccaaacaucgggucaaggccccggguucgcaauauaccuagcagaauuaguaucuacuggacgauugugaaaccaggagauauccugcuaaucaacucuacugguaaucucauugcuccgaggggcuacuucaagauacgguccgggaaaagcucgaucaugcgcucugacgcccccauuggaaaauguaacuccgaaugcaucacaccuaauggcucaauaccaaacgacaagcccuuucagaaugucaaccgaauuaccuauggugcguguccuagauacgugaaacagaauacucugaagcuggcaacagggaugaggaacgugccagagaaacaaacccggggaaucuucggcgccaucgcuggcuuuauugaaaaugggugggagggaauggucgaugguugguauggcuuccgucaccagaacagugaggggacgggacaggccgcagaccuuaagagcacccaagcugccaucaaucagauuaacggcaaauugaaccgccucauagguaagacaaaugaaaaguuccaccagaucgagaaagaauuuuccgagguugaagggaggauucaggaucuggagaaguacguggaggacacuaaaaucgauuuauggucuuauaacgcggaacugcucguagcccuugagaaucaacauaccaucgaccugacagauagcgaaaugaacaaguuguucgagagaacuaaaaagcagcuacgggaaaaugcagaggacaugggcaacggaugcuuuaagauuuaccacaaaugugauaaugcuugcauaggcucaauccgaaacgggaccuaugaccaugauguguaccgcgacgaggcccugaauaacagauuccagauuaagggagucgaacucaaaagugguuacaaggacuggauccuguggauuuccuuugcuaucagcugcuuccuucuguguguggccuugcucggcuuuauaaugugggcaugccagaaagggaauaucagguguaacauuugcaucuga

SEQ ID NO: 128818 - RNA, 1701 nt, Artificial Sequence
  derived and/or modified sequence opt3 from hemagglutinin__InfluenzaA__AEG65758
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacagguggcauuugcgacuccccacaccagauccuagauggggagaauuguacccucauagacgcucugcuuggagauccgcagugcgacggcuuccaaaacaaaaagugggaucuguuuguggaaagaucuaaagccuauucgaauuguuaccccuaugacgucccugauuacgcaucauugaggagccucguggccaguuccgguacucuggaguucaacaaugaaucuuuuaacuggacagggguuacccagaauggaacgagcuccgcuugcaagcggcgcucaaacaauaguuucuuuagccgacugaacuggcucacucauuuaaaguucaaauauccagcacugaaugugaccaugcccaacaacgagaaguuugacaaacuuuacaucuggggcguccaccauccuggcacagauaaugaccagauuuucuuguaugcccaggcuucugggcguaucacuguguccaccaagagaucacaacagacaguaauuccaaacaucggaagcaggccccggguucgcaauauaccuaguagaauuucuaucuacuggaccauugugaaaccaggugauauccugcuaaucaacuccacgggcaaucucauugccccgaggggguacuuuaagauacggagcggaaagucgucuaucaugcgcuccgacgcgcccauuggcaaauguaacucagagugcaucacuccuaaugguaguauaccaaacgacaagcccuuccagaaugucaaccgaauuacauauggggcauguccuagauacgugaaacagaauacccugaaacuugccacuggaaugaggaacgugccagaaaagcaaacacggggcaucuuuggcgcuaucgccggguucauugagaauggaugggaagguauggucgauggcugguauggguuucgucaccagaacagcgagggaaucggccaggcagcugaccugaaguccacccaagccgcgauuaaucagauaaacgguaaauugaaccgccucaucgggaagacgaaugagaaguuccaccagauugaaaaagaguucucugaaguugagggcagaauccaggaucuggaaaaguacguggaggacaccaaaaucgauuuauggagcuauaacgccgagcugcucguagcacuugaaaaucaacauacaauugaccugacugauucagagaugaacaaguuguuugaaaggaccaaaaagcagcuacgggagaaugcugaagacaugggaaacggcugcuucaagauauaccacaaaugugauaaugccugcaucgggaguauucgaaacggaacauaugaccaugauguguaccgcgacgaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 128819 - RNA, 1701 nt, Artificial Sequence; identical to SEQ ID NO: 122297
  derived and/or modified sequence opt3 from hemagglutinin__InfluenzaA__AEG65769

SEQ ID NO: 128820 - RNA, 1701 nt, Artificial Sequence
  derived and/or modified sequence opt3 from hemagglutinin__InfluenzaA__AEG65780
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauaaaaucgaggugacuaacgcgaccgaacugguacaaucuucaaguacaggugagauuugcaauagcccacaccagauccuagacggcgaaaacuguacccucauagaugcucugcuuggggacccgcagugcgauggauuucagaauaagaaaugggaccuguucguggagagauccaaggcccauucuaacuguuaucccuacgaugucccugacuaugcaucguugaggucacucguggccgcuagcggcacucuggaauuuaauaacgagaguuucaauuggacagguguuacccaaaacgggacguccucugcaugcauccggcgcagcaauaacuccuuuuucucacgacugaauuggcucacucacuuaaacuuuaaguacccagcccugaacgugaccaugcccaauaacgagcaguucgauaaacuuuauauuuggggaguccaucacccuggcacagacaaggaucagaucuuuuuguacgcucaggccgcgggccguauuacugugaguaccaaaagaagccaacaggcaguaaucccaaauauagggucuaggccccggguucgcaacauuccuuccagagugucaaucuauuggacaauugucaagccaggagacauccugcuaaucaauagcaccgguaaccucauugccccgaggggcuacuucaaaauacggagugggaagucuuccaucaugcgcagcgaugcucccauuggaaaguguaauucggccugcaucacgccuaacggcucuauaccaaaugacaaacccuuucagaacgugaaucgaauuacuuacggugcauguccuagauaugugaagcagaacacacugaaacuugcuaccgggaugaggaaugucccagaaaagcaaacucggggaaucuucggcgccaucgcgggcuuuauugagaacgggugggaaggaaugguugacgguugguacggcuuccgucaccaaaauuccgaggggcgcggacaggccgcagaucugaaaucaacacaggcugccaucgaccagauuaacggcaaguugaacagacucauagguaaaaccaaugagaaguuccaucagaucgaaaaggaguuuagugaaguggaggggaggauucaggaucuggaaaaauauguagaggacacgaagaucgauuuauggagcuacaacgcugagcugcucguggcccuugaaaaucaacacaccaucgaccugacagauuccgagaugaacaaauuguucgaaaagacuaaaaagcagcuacgggagaaugcagaagacaugggcaacggaugcuuuaagauuuaucauaaaugugauaaugccugcauaggcucuauccgaaacgggaccuacgaccacgaugucuaucgcgacgaggcucugaauaacagauuccagauuaagggaguggagcucaaaagcgguuacaaggacuggauccuguggauuucauuugcgaucaguugcuuccuucuguguguugcauugcucggcuuuauaaugugggccugccagaaagggaauaucagguguaacauuugcaucuga

SEQ ID NO: 128821 - RNA, 1701 nt, Artificial Sequence
  derived and/or modified sequence opt3 from hemagglutinin__InfluenzaA__AEG65813
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaccgauuuaugguccuacaacgccgagcugcucguggcucuugaaaaucagcacacaaucgaccugacugauucugagaugaacaaguuguucgaaaagaccaagaaacagcuacgggagaaugccgaagacaugggcaacggaugcuuuaagaucuaucauaagugugauaaugcaugcauuggcagcauacgaaacgggacauacgaccacgaugucuaucgcgacgaggcccugaauaacagauuccagaucaaaggaguggagcucaagucagguuacaaagacuggauucuguggaucaguuuugcuauuuccugcuuccuucuguguguugcguugcucggcuuuaucaugugggcaugccaaaaggggaauauaagguguaacaucugcauuuga

SEQ ID NO: 128822 - RNA, 1701 nt, Artificial Sequence
  derived and/or modified sequence opt3 from hemagglutinin__InfluenzaA__AEG79801
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugacagagagggaaggaugaacuacuauuggacacugguggaacccggugauaagauuacuuucgaggccaccggcaaccuagucguuccucgguacgcuuuugccauggaacgcaaugcaggguccggaaucauaauuagcgacacaccagugcaugauugcaacaccacgugucagacuccgaaaggcgcuaucaauacaucgcuccccuuccaaaacauucacccuaucaccaucgguaagugcccaaaguauguaaaaucuacuaagcugagacuugccacagggcugaggaaugugcccuccauucagucacggggauuguuuggcgcgauagccggcuucaucgaagggggauggaccgguauggucgacggcugguacggguaucaucaccagaacgaacagggaaguggcuacgcagcugaccucaaaagcacgcaaaaugccauugauaagaucaccaacaaaguuaauuccgugauagagaagaugaacacacaguuuacugcuguggguaaggaguucaaucaccuggaaaaacgcauugagaacuuaaauaagaaagucgacgauggguuccuggacaucuggaccuacaacgccgaacuccuugugcuguuggagaaugaacgaacacuagauuaucaugacucuaacguaaagaaccuguacgagaaaguuagaaaucagcucaagaacaaugcaaaggagaucggcaacggauguuuugaguucuaucacaaaugcgauaauacuuguauggaaagcgugaagaacggcaccuacgacuauccuaaauacucagaagaggccaagcugaauagggaagagauugauggggucaaacuugagaguacacggaucuaucagauucuggcuauauacuccaccguggcgagcucuuugguccucgugguuucacugggagcaaucaguuuuuggaugugcagcaacgguuccuuacaaugccguauuuguaucuga

SEQ ID NO: 128823 - RNA, 1701 nt, Artificial Sequence
  derived and/or modified sequence opt3 from hemagglutinin__InfluenzaA__AEG79807
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaaggaaaauagcuacccaaaauuaucuaaguccuauauaaacgauaagggaaaagagguacugguucuuuggggcauccaccaccccucaacgacugcugaccaacagagcauuuaccagaaugccgaugcguacguguucgucggcaccagucgcuauucuaagaaauuuaagccugagaucgcaauucgaccaaaagugcgugaccaggaagggagaaugaacuacuauuggacauugguggagcccggagauaagaucacuuucgaagccaccgguaaccuggucguuccuagguacgcuuuugccauggagcggaaugcaggcuccgggauaauuaucagcgacacaccagugcaugauugcaacaccacgugucaaacuccgaaaggagcuauuaauacaucgcuacccuuccagaacauccacccuaucaccauuggcaagugcccaaaguauguaaaaucuacuaagcuccgccuggccacaggucuuagaaaugugcccuccauacagucaagggggcuguuuggagcgaucgccggcuucauugaaggcggguggaccggaauggucgacgguugguacggcuaucaucaccagaacgagcaagggaguggauacgcagcugacuugaaaagcacgcagaaugccaucgauaagauaaccaacaaaguuaauuccgugauugagaagaugaacacacaguuuacugcugugggcaaggaguucaaucaccucgagaaacggaucgaaaaccugaauaagaaagucgacgaugguuucuuagacaucuggaccuacaacgccgagcugcucgugcuucuggaaaaugagcgcacauuggauuaucaugacucuaacguaaagaaccuauacgagaaaguucgaaaucagcugaagaacaaugcaaaggaaauugggaacggcuguuuugaguucuaucacaaaugcgauaauacuuguauggaaagcgugaagaacggaaccuacgacuauccuaaauacucagaggaagccaagcucaauagagaggagaucgauggcgucaaacuggaaaguacaaggauuuaucaaauacuugcuaucuacuccaccguggcgagcucucuggucuuggugguuucacucggggcaauuaguuuuuggaugugcagcaacggaucccugcagugccggaucuguaucuga

SEQ ID NO: 128824 - RNA, 1701 nt, Artificial Sequence
  derived and/or modified sequence opt3 from hemagglutinin__InfluenzaA__AEG79835
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucaauuuaccagaacgccgacaccuacguguucgucggaacaagccgcuauaguaagaaauuuaagccugagaucgcgauucgaccaaaagugcgugaucaggaggguagaaugaauuacuauuggacuuugguggaacccggcgacaagaucaccuucgaggcaacagggaaccuggucguuccuagguacgccuuugcuauggaacggaacgccggaucuggcauaauuaucuccgauaccccagugcaugacugcaauacgacuugucaaacaccgaaaggugcaauuaacaccagccuacccuuccagaauauccacccuaucacuauugggaagugcccaaaguauguaaaaucgacaaagcuccgccuggcuaccggacuuagaaacgugcccucuauacaguccaggggccuguuuggcgccaucgcgggguucauugagggagguuggacgggcauggucgacgggugguacggauaucaucaccagaaugaacaaggcucagguuacgccgcagauuugaaaaguacccagaacgcuaucgacaagauaacaaauaaagugaacagcguuauugagaagaugaauacucaguuuaccgccguggggaaggaguucaaccaccucgaaaaacggaucgagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagauuggaaauggcuguuuugaguucuaucacaaaugcgacaacaccuguauggagucugugaagaaugggacauacgauuauccuaaauacagcgaagaggcaaagcucaacagagaagagaucgacggagucaaacuggagucaaccaggauuuaucaaauacuugccaucuacaguacuguggcuuccagccuggucuuggugguuucucucggugcgauuucauuuuggaugugcaguaauggcagccugcagugccggaucuguaucuga

SEQ ID NO: 128825 - RNA, 1701 nt, Artificial Sequence
  derived and/or modified sequence opt3 from hemagglutinin__InfluenzaA__AEH59363
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagaaugccgaugcguacguguucgucgggacuucuaaguauuccaaaaaguuuaaaccugagauugcagugcgcccaaaggugcgagaccaagagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcacgauugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaccaucaaaacgcacagggaagcggcuacgcugccgaccugaaguccacccagaaugcuaucgauaaaauuacgaacaagguaaauucuguuaucgaaaagaugaacacccaguuuacagccguggguaaagaguucaaucacuuagagaagaggauagaaaaccugaauaaaaaggucgacgauggguuccucgacauuuggacuuacaacgcagagcuucugguguugcuagaaaaugagcggacccuggauuaucacgacagcaacgugaaaaaccucuacgaaaagguucgcucacaacugaagaauaacgccaaagagaucggcaauggauguuuugaguucuaucauaagugcgauaacacauguauggaaagugugaaaaauggcacuuacgacuauccuaaguacuccgaggaagcuaaacuuaaccgagaggaaaucgauggggucaagcuggagagcaccagaauuuaucagaucuuggcgauuuacucuacaguggcaucaagucucguccuggugguuagcuuaggagccauauccuuuuggaugugcucuaaugguucgcugcagugcaggaucuguauuuga

SEQ ID NO: 128826 - RNA, 1701 nt, Artificial Sequence
  derived and/or modified sequence opt3 from hemagglutinin__InfluenzaA__AEH59367
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauugggcccugguggaacccggugauaagauuacauucgaggcuacuggcaaccuagucguuccuagguacgccuuugcaauggaacggaaugcuggguccggaaucauaauuagcgacaccccagugcaugauugcaacacaaccugucaaacgccgaaaggcgccaucaauacuucgcuccccuuccagaacauucacccuaucacaaucgguaagugcccaaaguauguaaaaucuaccaagcugcgccuugcgacugggcugagaaaugugcccuccauucagucaaggggauuguuuggcgccauagcaggcuucaucgaagggggauggacagguauggucgacggcugguacggguaucaucaccagaacgaacaaggaaguggcuacgcugccgaccucaaaagcacccagaaugcuauugauaagaucacgaacaaaguuaauuccgugauagagaagaugaacacccaguuuacagccguggguaaggaguucaaucaccuggaaaaacggauugagaacuuaaauaagaaagucgacgauggguuccuggacaucuggacuuacaacgcagaacuccuugugcuguuggagaaugaacgcacccuagauuaucaugacucuaacguaaagaaccuguacgagaaaguucgaaaucagcucaagaacaaugccaaggagaucggcaacggauguuuugaguucuaucacaaaugcgauaauacauguauggaaagcgugaagaacggcacuuacgacuauccuaaauacucagaagaggcuaagcugaauagagaagagauugauggggucaaacuugagaguaccaggaucuaucaaauucuggcgauauacuccacaguggcaagcucuuugguccucgugguuucacugggagccaucaguuuuuggaugugcagcaacgguuccuuacagugccggauuuguaucuga

SEQ ID NO: 128827 - RNA, 1701 nt, Artificial Sequence
  derived and/or modified sequence opt3 from hemagglutinin__InfluenzaA__AEH59369
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaaggccagcuccuggcccaaucacgauucaaacaagggugucacagcugcauguccucaugccggggcuaaaggauuuuauaagaaucugaucuggcucgugaaaaagggcaacaguuacccaaaauuaagcaagucuuauauaaaugacaagggcaaagaaguacugguucuuugggggauccaccaccccuccaccacggccgaucaacagucauuguaccagaacgcggacacuuacguguucgucggaaccagccgcuauaguaagaaauuuaagccugagauugcaauccgaccaaaagugcgugaucaggaggguagaaugaauuacuauuggacacugguggaacccggcgacaagauuacuuucgaggccaccgggaaccuagucguuccuagguacgcuuuugccauggaacggaacgcaggaucuggcaucauaauuuccgauacaccagugcaugacugcaauaccacgugucaaacuccgaaaggugcuaucaacacaagccuccccuuccagaauauucacccuaucaccaucgggaagugcccaaaguauguaaaaucgacuaagcugcgccuugccacaggacugagaaacgugcccucuauucaguccaggggcuuguuuggcgcgauagccggguucaucgagggagguuggaccggcauggucgacgggugguacggauaucaucaccagaaugaacaaggcucagguuacgcagcugaucucaaaaguacgcagaacgccauugacaagaucaccaauaaagugaacagcguuauagagaagaugaauacacaguuuacugcuguggggaaggaguucaaccaccuggaaaaacggauugagaauuuaaacaagaaagucgaugacggcuuccuggauaucuggaccuacaaugccgaacuccuugugcuguuggagaacgaacgcacacuagacuaucaugauuccaauguaaagaaccuguacgagaaaguucgaaaccagcucaagaauaacgcaaaggagaucggaaauggcuguuuugaguucuaucacaaaugcgacaacacuuguauggagucugugaagaaugggaccuacgauuauccuaaauacagcgaagaggccaagcugaacagagaagagauugacggagucaaacuugagucaacaaggaucuaucaaauucuggcuauauacaguaccguggcguccagcuugguccucgugguuucucugggugcaaucucauuuuggaugugcaguaauggcagcuuacagugccggauuuguaucuga

SEQ ID NO: 128828 - RNA, 1701 nt, Artificial Sequence; identical to SEQ ID NO: 128825
  derived and/or modified sequence opt3 from hemagglutinin__InfluenzaA__AEH59371

SEQ ID NO: 128829 - RNA, 1701 nt, Artificial Sequence
  derived and/or modified sequence opt3 from hemagglutinin__InfluenzaA__AEH59373
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagagagguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaggguuuuauaagaaucugaucuggcucgugaaaaagggaaacaguuacccaaaauuaagcaagucuuauauaaaugacaagggcaaagagguacugguucuuuggggcauccaccaccccuccacgacugcugaucaacagucauuguaccagaacgccgacaccuacguguucgucgggacaagccgcuauaguaagaaauuuaagccugagauugcgauccgaccaaaagugcgugaucaggaaggaagaaugaauuacuauuggacucugguggagcccggugacaagauuaccuucgaagcaacaggcaaccuagucguuccuagguacgccuuugcuauggagcggaacgccgggucuggaaucauaauuuccgauaccccagugcaugacugcaauacgacuugucaaacaccgaaaggcgcaaucaacaccagccuccccuuccagaauauucacccuaucacuaucgguaagugcccaaaguauguaaaaucgacaaagcugcgccuugcuaccgggcugagaaacgugcccucuauucaguccaggggauuguuuggcgccauagcgggcuucaucgaagggggauggacggguauggucgacggcugguacggguaucggcaucagaaugagcaaggaucaggcuacgccgcagaucucaaaaguacccagaacgcuauugacaagaucacaaauaaagugaacagcguuauagagaagaugaauacucaguuuaccgccguggguaaggaguucaaccaccuggaacgccgaauugaaaauuuaaacaaaaaggucgaugacggguuccuggauaucuggacauacaaugcugagcuccuugugcuguuggaaaacgagagaacucuagacuaucacgauuccaauguaaagaaccuguacgagaagguuaggaaccagcucaaaaauaacgccaaggaaaucggcaauggauguuuugaguucuaucauaagugcgacaacaccuguauggaaucugugaaaaauggcacauacgauuauccuaaguacagcgaggaagcaaaacugaaccgggaggagauugacggggucaaacuugaaucaacccguaucuaucaaauucuggccauauacaguacuguggcuuccagcuugguccucgugguuucucugggagcgaucucauuuuggaugugcaguaaugguagcuuacagugccgcauuuguaucuga

SEQ ID NO: 128830 - RNA, 1701 nt, Artificial Sequence; identical to SEQ ID NO: 128825
  derived and/or modified sequence opt3 from hemagglutinin__InfluenzaA__AEH59375

SEQ ID NO: 128831 - RNA, 1701 nt, Artificial Sequence
  derived and/or modified sequence opt3 from hemagglutinin__InfluenzaA__AEH59379
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaccggcaauggauguuuugaguucuaucacaaaugcgacaacacauguauggaaagcgugaagaauggcaccuacgauuauccuaaauacucagaagaggcaaagcugaacagagaagagaucgacggggucaaacuugagaguacuaggauuuaucaaauccuggccauuuacuccacgguggcuagcucuuugguccucgugguuucacugggagcgauaaguuuuuggaugugcagcaaugguuccuuacagugccggaucuguauuuga

SEQ ID NO: 128832 - RNA, 1701 nt, Artificial Sequence; identical to SEQ ID NO: 128825
  derived and/or modified sequence opt3 from hemagglutinin__InfluenzaA__AEH59381

SEQ ID NO: 128833 - RNA, 1701 nt, Artificial Sequence
  derived and/or modified sequence opt3 from hemagglutinin__InfluenzaA__AEH59383
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcauaucuuauaucaaugacaagggcaaggaaguacugguucuuugggggauucaccaccccuccacgacugcugaucaacagucauuguaccagaacgccgacaccuacguguucgucggaacaagccgcuauaguaaaaaguuuaaaccugagaucgcgauucgaccaaaggugcgugaucaggaggguagaaugaauuacuauuggacucugguggaacccggcgacaaaaucaccuucgaggcaacagggaaccuagucguuccuagguacgccuuugcuauggaacggaacgccggaucuggcauaauuaucuccgauaccccagugcaugacugcaauacgacuugucaaacaccgaagggugcaauuaacaccagccuccccuuccagaauauccacccuaucacuauugggaaaugcccaaaguauguaaagucgacaaaacugcgccuugcuaccggacugagaaacgugcccucuauacaguccaggggcuuguuuggcgccaucgcgggguucauugagggagguuggacgggcauggucgacgggugguacggauaucaucaccagaaugaacaaggcucagguuacgccgcagaucucaagaguacccagaacgcuaucgacaaaauaacaaauaaggugaacagcguuauugagaaaaugaauacucaguuuaccgccguggggaaggaguucaaccaccuggaaaagcggaucgagaauuuaaacaaaaaggucgaugacggcuuccuggauaucuggacauacaaugcugaacuccuugugcuguuggagaacgaacgcacucuagacuaucaugauuccaauguaaagaaccuguacgagaagguucgaaaccagcucaaaaauaacgccaaggagauuggaaauggcuguuuugaguucuaucacaagugcgacaacaccuguauggagucugugaaaaaugggacauacgauuauccuaaguacagcgaagaggcaaaacugaacagagaagagaucgacggagucaaacuugagucaaccaggauuuaucaaauacuggccaucuacaguacuguggcuuccagcuugguccucgugguuucucugggugcgauuucauuuuggaugugcaguaauggcagcuuacagugccggaucuguaucuga

SEQ ID NO: 128834 - RNA, 1701 nt, Artificial Sequence
  derived and/or modified sequence opt3 from hemagglutinin__InfluenzaA__AEH59385
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacgcguacauuuucguggggaccagucgcuauucuaagaaauuuaagccugagaucgcaauucgaccaaaaguccgugaucaggagggaagaaugaauuacuauuggacacugguggaacccggugacaagaucacuuucgaggccaccggcaaccuaguggucccuagguacgcuuuugccauggaacggaacgcaggguccggaauaauuaucagcgauacaccaguucaugacugcaauaccacgugucaaacuccgaaaggcgcuauuaacacaucgcuccccuuccagaauauccacccuaucaccauugguaagugcccaaaguaugugaaaucuacuaagcugcgccuugccacagggcugagaaacguacccuccauacagucaaggggauuguuuggcgcgaucgccggcuucauugaagggggauggaccgguaugguggacggcugguacggguaucaucaccagaaugaacaaggaaguggcuacgcagcugaucucaaaagcacgcagaacgccaucgacaagauaaccaauaaagucaacuccgugauugagaagaugaauacacaguuuacugcuguugguaaggaguucaaccaccuggaaaaacggaucgagaauuuaaacaagaaaguggaugacggguuccuggauaucuggaccuacaaugccgaacuccuuguccuguuggagaacgaacgcacacuagacuaucaugauucuaaugugaagaaccuguacgagaaaguacgaaaccagcucaagaauaacgcaaaggagauuggcaauggauguuuugaguucuaucacaaaugcgacaacacuuguauggaaagcguuaagaauggcaccuacgauuauccuaaauacucagaagaggccaagcugaacagagaagagaucgacggggugaaacuugagaguacaaggauuuaucaaauacuggcuaucuacuccaccgucgcgagcucuuuggugcucgucgugucacugggagcaauuaguuuuuggaugugcagcaaugguuccuuacagugccggaucuguaucuga

SEQ ID NO: 128835 - RNA, 1701 nt, Artificial Sequence; identical to SEQ ID NO: 128825
  derived and/or modified sequence opt3 from hemagglutinin__InfluenzaA__AEH59387

SEQ ID NO: 128836 - RNA, 1701 nt, Artificial Sequence
  derived and/or modified sequence opt3 from hemagglutinin__InfluenzaA__AEH59393
augaaggccauccugguggucauucucuacaccuucgcuacagcaaacgccgacacucuuugcauaggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaggauuuuauaagaaucugauauggcuggugaaaaagggcaacaguuacccaaaacucagcaagucuuauaucaaugacaagggcaaagaaguauuaguucugugggggauucaccaccccuccacgacugcugaucaacagucacuuuaccagaacgccgacaccuacguguucgucggaacaagccgcuauaguaagaaauuuaagccugagaucgcgauucgaccaaaagugcgugaucaggaggguagaaugaauuacuauuggacuuugguggaacccggcgacaagaucaccuucgaggcaacagggaaccuggucguuccuagguacgccuuugcuauggaacggaacgccggaucuggcauaauuaucuccgauaccccagugcaugacugcaauacgacuugucaaacaccgaaaggugcaauuaacaccagccuacccuuccagaauauccacccuaucacuauugggaagugcccaaaguauguaaaaucgacaaagcuccgccuggcuaccggacuuagaaacgugcccucuauacaguccaggggccuguuuggcgccaucgcgggguucauugagggagguuggacgggcauggucgacgggugguacggauaucaucaccagaaugaacaaggcucagguuacgccgcagauuugaaaaguacccagaacgcuaucgacaagauaacaaauaaagugaacagcguuauugagaagaugaauacucaguuuaccgccguggggaaggaguucaaccaccucgaaaaacggaucgagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagauuggaaauggcuguuuugaguucuaucacaaaugcgacaacaccuguauggaaucugugaagaaugggacauacgauuauccuaaauacagcgaagaggcaaagcucaacagagaagagaucgacggagucaaacuggagucaaccaggauuuaucaaauacuugccaucuacaguacuguggcuuccagccuggucuuggugguuucucucggugcgauuucauuuuggaugugcaguaauggcagccugcagugccggaucuguaucuga

SEQ ID NO: 128837 - RNA, 1701 nt, Artificial Sequence
  derived and/or modified sequence opt3 from hemagglutinin__InfluenzaA__AEH59397
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccucacacgacaguaacaagggugucaccgccgcuuguccucaugcaggggccaagagcuuuuauaaaaaucugaucuggcucgugaaaaagggaaacucuuacccaaaauuauccaagucauauauaaaugauaagggcaaagaaguacugguucuuuggggcauccaccaccccagcacgagugcugaccaacagucuuuguaccagaacgccgaugcguacguguucgucgggacuuccaaguauagcaaaaaguuuaaaccugagauugcagugcgcccaaaggugcgagaccaggagggacguaugaauuacuauuggacccuggucgaacccggugauaaaaucacauucgaggccacuggcaaccuacucguuccuagauacgcuuuugccauggaaaggaacgcagggucgggaauuaucauaucugacaccccagugcaugauugcaauacaaccugucaaacgccgaagggcgcuauuaacacuucccugcccuuccagaauauccacccuauuacaaucgguaagugcccaaaauauguaaagucaaccaaacuucggcuggccacuggguugcgcaacgugcccaguauccagagcagaggacucuuuggcgcgauugccggcuucauagaagggggauggacagguauggucgacggcugguacggguaucaucaccagaaugaacaaggauccggcuacgcagcugaccugaagucuacccagaacgccaucgauaaaauuacgaauaaggugaacagcguuaucgagaagaugaauacccaguuuacagcuguggguaaagaguucaaccacuuagaaaagaggauagagaaucugaacaaaaaggucgacgauggguuccucgacauuuggacuuacaaugccgaacuucugguguugcuagagaacgaacggacccuggauuaucaugacucaaauguuaaaaaccucuacgagaagguacgcagucagcugaagaacaaugcaaaagagaucgaaaacggcuguuuugaguucuaucacaagugcgauaauacauguauggaauccgugaaaaacggaacuuacgacuauccuaaguacagcgaggaagccaaacuuaaucgagaggagaucgauggcgucaagcuggaaucuaccagaauuuaucaaaucuuggcuauuuacucaacaguggcgaguagccucguccuggugguuuccuuaggggcaauaucuuuuuggaugugcucgaacggaagccugcagugcaggaucuguauuuga

SEQ ID NO: 128838 - RNA, 1701 nt, Artificial Sequence
  derived and/or modified sequence opt3 from hemagglutinin__InfluenzaA__AEH59399
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacuauuguggaacccggcgacaagaucaccuucgaggcaacagggaaccuggucguuccuagguacgccuuugcuauggaacggaacgccggaucuggcauaauuaucuccgauaccccagugcaugacugcaauacgacuugucaaacaccgaaaggugcaauuaacaccagccuacccuuccagaauauccacccuaucacuauugggaagugcccaaaguauguaaaaucgacaaagcuccgccuggcuaccggacuuagaaacgugcccucuauacaguccaggggccuguuuggcgccaucgcgggguucauugagggagguuggacgggcauggucgacgggugguacggauaucaucaccagaaugaacaaggcucagguuacgccgcagauuugaaaaguacccagaacgcuaucgacaagauaacaaauaaagugaacagcguuauugagaagaugaauacucaguuuaccgccguggggaaggaguucaaccaccucgaaaaacggaucgagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagauuggaaauggcuguuuugaguucuaucacaaaugcgacaacaccuguauggagucugugaagaaugggacauacgauuauccuaaauacagcgaagaggcaaagcucaacagagaagagaucgacggagucaaacuggagucaaccaggauuuaucaaauacuugccaucuacaguacuguggcuuccagccuggucuuggugguuucucucggugcgauuucauuuuggaugugcaguaauggcagccugcagugccggaucuguaucuga

SEQ ID NO: 128839 - RNA, 1701 nt, Artificial Sequence
  derived and/or modified sequence opt3 from hemagglutinin__InfluenzaA__AEH59403
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggcacccggcgacaagauuaccuucgaagccacagggaaccuagucguuccuagguacgcuuuugccauggagcggaacgcaggaucuggcaucauaauuuccgauaccccagugcaugacugcaauacgacuugucaaacaccgaaaggugcuaucaacaccagccuccccuuccagaauauucacccuaucacuaucgggaagugcccaaaguauguaaaaucgacaaagcugcgccuugccaccggacugagaaacgugcccucuauucaguccaggggcuuguuuggcgcgauagccggguucaucgaaggagguuggacgggcauggucgacgggugguacggauaucaucaccagaaugagcaaggcucagguuacgcagcugaucucaaaaguacccagaacgccauugacaagaucacaaauaaagugaacagcguuauagaaaagaugaauacucaguuuaccgcuguggggaaggaguucaaccaccuggagaaacggauugaaaauuuaaacaagaaagucgaugacggcuuccuggauaucuggacauacaaugccgagcuccuugugcuguuggaaaacgagcgcacucuagacuaucaugauuccaauguaaagaaccuguacgaaaaaguucgaaaccagcucaagaauaacgcaaaggagaucggaaauggcuguuuugaguucuaucacaaaugcgacaacaccuguauggaaucugugaagaaugggacauacgauuauccuaaauacagcgaggaagccaagcugaacagagaggaaauugacggagucaaacuugagucaaccaggaucuaucaaauucuggcuauauacaguacuguggcguccagcuugguccucgugguuucucugggugcaaucucauuuuggaugugcaguaauggcagcuuacagugccggauuuguaucuga

SEQ ID NO: 128840 - RNA, 1701 nt, Artificial Sequence
  derived and/or modified sequence opt3 from hemagglutinin__InfluenzaA__AEH59407
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugguggaacccggcgacaagauuaccuucgaggcaacagggaaccuggucguuccuagguacgccuuugcuauggaacggaacgccggaucuggcaucauaauuuccgauaccccagugcaugacugcaauacgacuugucaaacaccgaaaggugcaaucaacaccagccuacccuuccagaauauucacccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaucaccagaaugaacaaggcucagguuacgccgcagauuugaaaaguacccagaacgcuauugacaagaucacaaauaaagugaacagcguuauagagaagaugaauacucaguuuaccgccguggggaaggaguucaaccaccucgaaaaacggauugagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagaucggaaauggcuguuuugaguucuaucacaaaugcgacaacaccuguauggaaucugugaagaaugggacauacgauuauccuaaauacagcgaagaggcaaagcucaacagagaagagauugacggagucaaacuggagucaaccaggaucuaucaaauucuugccauauacaguacuguggcuuccagccuggucuuggugguuucucucggugcgaucucauuuuggaugugcaguaauggcagccugcagugccggauuuguaucuga

SEQ ID NO: 128841 - RNA, 1701 nt, Artificial Sequence; identical to SEQ ID NO: 128840
  derived and/or modified sequence opt3 from hemagglutinin__InfluenzaA__AEH59409

SEQ ID NO: 128842 - RNA, 1701 nt, Artificial Sequence
  derived and/or modified sequence opt3 from hemagglutinin__InfluenzaA__AEH59411
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaucggaacgccggaucuggcaucauaauuuccgacaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgaaggagguuggacgggcauggucgaugggugguacggauaucaucaccagaaugagcaaggcucagguuacgccgcagaccucaaaaguacccagaacgcuauugauaagaucacaaauaaagugaacagcguuauagaaaagaugaauacucaguuuaccgccguggggaaggaguucaaccaccuggagaaacggauugaaaauuuaaacaagaaagucgacgauggcuuccuggacaucuggacauacaaugcugagcuccuugugcuguuggaaaacgagcgcacucuagauuaucaugacuccaauguaaagaaccuguacgaaaaaguucgaaaccagcucaagaauaacgccaaggagaucggaaauggcuguuuugaguucuaucacaaaugcgauaacaccuguauggaaucugugaagaaugggacauacgacuauccuaaauacagcgaggaagcaaagcugaacagagaggaaauugauggagucaaacuugagucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 128843 - RNA, 1701 nt, Artificial Sequence
  derived and/or modified sequence opt3 from hemagglutinin__InfluenzaA__AEH59413
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaagaacucagggagcagcugagcaguguguccucuuucgaacgguuugagaucuucccgaagacuagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccagcgcugaccaacagaguuuguaccagaaugccgaugcguacguguucgucgggacgucuaaguauuccaaaaaguuuaaaccugagaucgcagugcgcccaaaggugcgagaccaggagggacguaugaacuacuauuggacucuggucgaacccggugauaaaauuaccuucgaggccacaggcaaccuacucguuccuagauacgcuuuugccauggaaaggaaugcagggagcggaaucauaauuucggacacuccagugcaugauugcaacaccacaugucaaaccccggagggcgcuaucaauacgucucugcccuuccagaacauucacccuaucacuaucgguaagugcccaaaguauguaaaauccacaaaacuucggcuggccaccggguugcgcaaugugcccucaauucagaguagaggacucuuuggcgcgauagccggcuucaucgaagggggauggacugguauggucgacggcugguacggguaucaucaccagaacgagcaaggaagcggcuacgcagcugaccugaaguccacacagaaugccauugauaagaucaccaacaaaguuaauucugugauagagaagaugaacacgcaguuuaccgcuguggguaaggaguucaaucacuuagagaaaaggauugaaaaccugaauaagaaagucgacgauggguuccucgacaucuggacauacaacgccgagcuucugguguugcuagaaaaugagcggacucuggauuaucaugacagcaacguaaagaaccucuacgagaaaguucgcucacagcugaagaauaacgcaaaggaaaucggcaauggauguuuugaguucuaucacaaaugcgauaacaccuguauggaaagugugaagaauggcacauacgacuauccuaaauacuccgaggaagccaaacuuaaccgagaggagauugauggggucaagcuggaaagcacuagaaucuaucaaauuuuggcuauauacucuaccguggcgucaagucucguccuggugguuagcuuaggagcaaucuccuuuuggaugugcucuaaugguucgcugcagugcaggauuuguaucuga

SEQ ID NO: 128844 - RNA, 1701 nt, Artificial Sequence
  derived and/or modified sequence opt3 from hemagglutinin__InfluenzaA__AEH59585
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacaguggucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauucuaauguuaaaaaccuguacgagaaggugcgaagccagcucaaaaacaaugccaaggaaaucggcaacggauguuuugaguucuaucacaagugcgacaauacauguauggaaucagucaaaaacggcacuuacgauuauccaaaguacagugaggaagcaaaacugaauagagaggagauugacggggugaaacuugaauccaccaggaucuaucaaauucuggccauauacagcacagucgcuucuucauuggugcucguugugagucugggagcgaucagcuuuuggaugugcuccaacgguucuuuacagugccggauuuguaucuga

SEQ ID NO: 128845 - RNA, 1701 nt, Artificial Sequence
  derived and/or modified sequence opt3 from hemagglutinin__InfluenzaA__AEH59587
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccuuuauucagucaaggggauuguucggcgcgauagccggcuuuaucgaagggggauggacagguauggucgacggcugguacggguaucaucaccagaaugagcaaggaaguggcuacgcagcugaccucaaaagcacccagaacgccauugauaagaucacgaauaaagugaacuccguuauagagaagaugaauacccaguucacaguggucgguaaggaguucaacccucuggagaaacggauugaaaauuuaaacaagaaaguggacgauggguuucuggacaucuggacuuacaaugcugagcuccuuguacuguuggaaaacgagcgcacccuagauuaucacgacucuaauguuaagaaccuguacgagaaagugcgaagccagcucaagaacaaugccaaggaaaucggcaacggauguuucgaguuuuaucauaaaugcgauaauacauguauggaaucagucaagaacggcacuuacgacuauccaaaauacagugaggaagcaaagcugaauagagaggagauugauggggugaaacuugaauccaccaggaucuaucaaauucuggccauauacagcacagucgcuucuucauuggugcucguugugagucugggagcgaucagcuucuggaugugcuccaacgguucuuuacagugccggauuuguaucuga

SEQ ID NO: 128846 - RNA, 1701 nt, Artificial Sequence; identical to SEQ ID NO: 125849
  derived and/or modified sequence opt3 from hemagglutinin__InfluenzaA__AEH59589

SEQ ID NO: 128847 - RNA, 1701 nt, Artificial Sequence
  derived and/or modified sequence opt3 from hemagglutinin__InfluenzaA__AEH59591
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacaguggucgguaaggaguucaaccaccuggaaaaacggauugagaauuuaaacaagaaaguggaugacggguuccuggauaucuggacuuacaaugcugaacuccuuguacuguuggagaacgaacgcacccuagacuaucaugauagcaauguuaagaaccuguacgagaaagugcgaucacagcucaagaacaaugccaaggagaucggcaacggauguuuugaguucuaucacaaaugcgacaauacauguauggaaagugucaagaacggcacuuacgauuauccuaaauacuccgaagaggcaaagcugaauagagaagagauugacggggugaaacuugagagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 128848 - RNA, 1701 nt, Artificial Sequence
  derived and/or modified sequence opt3 from hemagglutinin__InfluenzaA__AEH59593
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguauuuaccagaacgccgaugcguacguguucgucgggacuucucgcuauuccaagaaauuuaagccugagaucgcaauucgaccaaaagugcgugaccaggaaggaagaaugaauuacuauuggaccuugguggagcccggugauaagaucacauucgaagccacuggcaaccuggucguuccuagguacgcuuuugccauggagcggaacgcagggagcggaauaauuaucucggacaccccagugcaugauugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugagcaaggaagcggcuacgcagcugacuugaaauccacccagaacgccaucgauaagauaacgaauaaagugaacucuguuauugagaagaugaauacccaguuuacagcuguggguaaggaguucaaccaccucgagaaacggaucgaaaaucugaacaagaaagucgacgauggguucuuagacaucuggacuuacaaugccgagcugcucgugcuucuggaaaacgagcgcaccuuggauuaucaugacagcaauguaaagaaccuauacgagaaaguucgaucacagcugaagaacaaugcaaaggaaauuggcaacggauguuuugaguucuaucacaaaugcgauaauacauguauggaaagugugaagaacggcacuuacgacuauccuaaauacuccgaggaagccaagcucaauagagaggagaucgauggggucaaacuggaaagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 128849 - RNA, 1701 nt, Artificial Sequence; identical to SEQ ID NO: 125483
  derived and/or modified sequence opt3 from hemagglutinin__InfluenzaA__AEH59595

SEQ ID NO: 128850 - RNA, 1701 nt, Artificial Sequence; identical to SEQ ID NO: 125849
  derived and/or modified sequence opt3 from hemagglutinin__InfluenzaA__AEH59597

SEQ ID NO: 128851 - RNA, 1701 nt, Artificial Sequence; identical to SEQ ID NO: 128844
  derived and/or modified sequence opt3 from hemagglutinin__InfluenzaA__AEH59599

SEQ ID NO: 128852 - RNA, 1701 nt, Artificial Sequence
  derived and/or modified sequence opt3 from hemagglutinin__InfluenzaA__AEH59601
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaacugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaaaacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguuaauucugugauagagaaaaugaacacccaguuuacaguggucgguaaggaguucaaucaccuggaaaagcggauugagaacuuaaauaaaaagguggaugacggguuccuggauaucuggacuuacaacgcugaacuccuuguacuguuggagaaugaacgcacccuagacuaucaugauagcaacguuaaaaaccuguacgagaaggugcgaucacagcucaaaaauaacgccaaggagaucggcaauggauguuuugaguucuaucacaagugcgacaacacauguauggaaagugucaaaaauggcacuuacgauuauccuaaguacuccgaagaggcaaaacugaacagagaagagauugacggggugaaacuugagagcaccaggaucuaucaaauucuggccauauacucuacagucgcuucaaguuuggugcucguugugagccugggagcgaucuccuuuuggaugugcucuaaugguucguuacagugccggauuuguaucuga

SEQ ID NO: 128853 - RNA, 1701 nt, Artificial Sequence; identical to SEQ ID NO: 125483
  derived and/or modified sequence opt3 from hemagglutinin__InfluenzaA__AEH59604

SEQ ID NO: 128854 - RNA, 1701 nt, Artificial Sequence; identical to SEQ ID NO: 125483
  derived and/or modified sequence opt3 from hemagglutinin__InfluenzaA__AEH59614

SEQ ID NO: 128855 - RNA, 1701 nt, Artificial Sequence
  derived and/or modified sequence opt3 from hemagglutinin__InfluenzaA__AEH59624
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuucuaccagaacgccgacgcguacguguuugucgggaccagucgcuauucuaagaaauucaagccagagauugcaauccgacccaaagugcgugaucaggagggaagaaugaauuacuauuggacuuugguggaaccuggugacaagauuacauuugaggccacuggcaaccuggucguuccaagguacgcuuucgccauggaacggaacgcaggguccggaaucauaauuagcgauaccccggugcaugacugcaauacaaccugucaaacgcccaaaggcgcuaucaacacuucgcuaccuuuucagaauauucacccaaucacaaucgguaagugccccaaguauguaaaaucuaccaagcuccgccuggccacugggcuuagaaacgugccuuccauucagucaaggggacuguucggcgcgauagccggcuuuaucgaagggggauggacagguauggucgacggcugguacggguaucaucaccagaaugaacaaggaaguggcuacgcagcugauuugaaaagcacccagaacgccauugacgagaucacgaauaaggugaacuccguuauagagaaaaugaauacccaguucacagcuguggguaaggaguucaaccaccucgaaaagcggauugaaaaucugaacaaaaaggucgaugacggguuuuuagauaucuggacuuacaaugccgagcugcucgugcuucuggaaaacgagcgcaccuuggacuaucaugauucuaauguuaaaaaccuauacgagaagguacgaagccagcugaaaaacaaugcaaaggaaaucggcaacggauguuucgaguuuuaucacaagugcgacaauacauguauggaaucagugaaaaacggcacuuacgauuauccaaaguacagugaggaagccaaacucaauagagaggagauugacggggucaagcuggaauccaccaggaucuaucaaauucuugcuauauacagcacaguggcgucuucacuggucuuggugguuagucucggagcaaucagcuucuggaugugcuccaacgguucucugcagugccggauuuguaucuga

SEQ ID NO: 128856 - RNA, 1698 nt, Artificial Sequence
  derived and/or modified sequence opt3 from hemagglutinin__InfluenzaA__AEH77259
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauguucccuaaggagaguuccuggccaaaccacacugucacaggugugucugccagcugcucccauaauggggaaucaaguuuuuaucggaacuuacuguggcuuaccgagaaaaauggauuguaccccaaccugagcaagucuuaugcaaauaacaaagaaaaggaggugcuaguucucuggggcgugcaccacccuccauccauuucagaccagaaaacgcuguaccauacugaaaacgccuacgucagcguggugaguucucacuauucccgcaaguucacccccgagaucgcuaagcgaccuaaaguccgugaucaggagggcagaauaaauuacuauuggacacuucuggaaccaggggacacuaucauuuuugaggcaaacggaaauuugaucgccccgagguacgcuuucgcccucagccgggguuuuggcucggggauuaucaacucuaaugcgcccauggauaagugugacgcaaaaugccagaccccucaaggagccauaaacuccucacugccauuccagaauguucaucccgugacaauuggcgaauguccuaaguauguacgcagugcuaaauuaagaauggugaccggucugaggaacaucccaagcauucagucccgggggcucuuuggagccaucgcaggcuucaucgagggcggguggacgggaauggucgaugguugguacggcuaucaccaccagaaugaacaagggucuggauacgcugccgaccagaagucaacucagaacgcgauuaauggcauaacaaacaaaguaaauucaguuaucgagaagaugaacacccaguuuacugccguggguaaggaguucaauaaacuugaacgccgaauggagaaccugaacaagaaagucgaugacggguucauugauaucuggacauacaaugcagaauugcuagugcugcucgagaacgaaagaacccuggacuuucaugacaguaauguaaagaaccuuuaugagaaaguuaagaaucaacugaagaacaaugcuaaagagauaggcaacggaugcuucgaauuuuaccacaaguguaaugaugagugcauggaauccgugaaaaacggcacguaugacuaccccaaguauagcgaggagucuaaauugaauagggaaaagauugauggggucaagcucgagucaaugggaguguaccagauccuggccaucuauaguaccgucgcuagcuccuuaguguuccugguuucucuaggugccauuucguuuuggaugugcagcaacggcucccuccagugucggaucugcauuuga

SEQ ID NO: 128857 - RNA, 1701 nt, Artificial Sequence; identical to SEQ ID NO: 124672
  derived and/or modified sequence opt3 from hemagglutinin__InfluenzaA__AEH77270

SEQ ID NO: 128858 - RNA, 1701 nt, Artificial Sequence; identical to SEQ ID NO: 122048
  derived and/or modified sequence opt3 from hemagglutinin__InfluenzaA__AEH77279

SEQ ID NO: 128859 - RNA, 1701 nt, Artificial Sequence; identical to SEQ ID NO: 125787
  derived and/or modified sequence opt3 from hemagglutinin__InfluenzaA__AEI29215

SEQ ID NO: 128860 - RNA, 1701 nt, Artificial Sequence; identical to SEQ ID NO: 124685
  derived and/or modified sequence opt3 from hemagglutinin__InfluenzaA__AEI29225

SEQ ID NO: 128861 - RNA, 1701 nt, Artificial Sequence
  derived and/or modified sequence opt3 from hemagglutinin__InfluenzaA__AEI29591
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacagaauacuagacggcaucaacuguacccucauagaugcucugcuuggggacccgcauugcgauggauuccagaaugagaaaugggaccuguuuguggaaaggagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucacuaugccuaauaacgacaacucagauaaguuauacauuuggggugugcaccauccaaguaccgacaaagagcagacaaaucuguauguacaggcaagcggcaagguuacugugucuaccaaacguucccagcaaacagucauccccaacguggggucaagaccuugggugaggggacuuagcagucgggucucuauuuacuggaccaucguuaagccaggcgacauauuggugauuaauuccaacgguaaucugaucgccccgcgcggguacuauaaaaugagaacgggaaagagcucgauuaugaggucugaugcucccaucggcacuuguuccucagagugcaucacaccuaacggcaguauuccaaaugacaagcccuuucagaacguaaauaaaauaaccuacggggccuguccuaaguaugugaaacagaacacucuaaagcucgcgacaggaaugcggaaugucccagaaaaacagacccgcgguaucuucggcgcaauugccggguuuaucgagaacggaugggaaggcaugauagaugguugguacggguuccgacaccaaaauagcgagggcacgggacaggcugccgaccugaaguccacccaggcagcuauugaucaaaucaacggcaaacuuaauagagugaucgagaagacaaacgaaaaguuucaccagauugagaaagaguucucugaaguugaagggaggauccaggaccuggagaaguauguggaggauacuaaaauugacuuguggagcuacaacgccgaacuccuggucgcguuagagaaucagcauaccauagaucugacagacucagaaaugaacaaacucuucgagaagacucggcgucaacuucgcgaaaaugccgaggauaugggaaacgguugcuuuaagaucuaucacaagugugacaaugcaugcauuggcaguaucagaaacgggaccuacgaccaugauguguacagggacgaggcucugaauaaccgguuccagaucaaaggaguagaauugaaguccggcuauaaagauuggauucuauggauuagcuuugccaucucuugcuuccugcucuguguugugcugcuugguuuuauuaugugggcuugccagaaggggaauauccgauguaacauuugcaucuga

SEQ ID NO: 128862 - RNA, 1701 nt, Artificial Sequence; identical to SEQ ID NO: 122048
  derived and/or modified sequence opt3 from hemagglutinin__InfluenzaA__AEI54347

SEQ ID NO: 128863 - RNA, 1701 nt, Artificial Sequence; identical to SEQ ID NO: 122134
  derived and/or modified sequence opt3 from hemagglutinin__InfluenzaA__AEI54358

SEQ ID NO: 128864 - RNA, 1701 nt, Artificial Sequence; identical to SEQ ID NO: 122649
  derived and/or modified sequence opt3 from hemagglutinin__InfluenzaA__AEI54369

SEQ ID NO: 128865 - RNA, 1701 nt, Artificial Sequence; identical to SEQ ID NO: 122532
  derived and/or modified sequence opt3 from hemagglutinin__InfluenzaA__AEI54380

SEQ ID NO: 128866 - RNA, 1701 nt, Artificial Sequence; identical to SEQ ID NO: 128795
  derived and/or modified sequence opt3 from hemagglutinin__InfluenzaA__AEI54391

SEQ ID NO: 128867 - RNA, 1701 nt, Artificial Sequence
  derived and/or modified sequence opt3 from hemagglutinin__InfluenzaA__AEI54402
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcuauagcccacaccagauccuagacggcgaaaauuguacccucauagaugcucugcuuggggacccgcagugcgauggauuucaaaacaaaaagugggaccuguucguggagagauccaaagccuacucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguacccagcacugaaugugaccaugcccaacaacgagaaauucgauaaacuuuauauuuggggaguccaccauccuggcacagacaaugaucagaucuuuuuguacgcccaggcuagcggccguauuacugugucuaccaagagaucccaacagacaguaaucccaaacauagggucaaggccccggguucgcaauauuccuagcagaaucaguauuuacuggaccaucgugaagccaggagacauccugcuaauuaacucuacggguaaucucauagccccgaggggcuauuucaaaauccgguccggaaagagcucgauuaugcgcucugaugcgcccaucgggaaguguaacuccgaaugcauaacuccuaauggcucaauuccaaacgacaaacccuuucagaaugucaaccgaaucacauacggugcauguccuagauaugugaagcagaauacccugaaacuugccacugggaugaggaacgugccagagaagcaaacacggggaaucuucggcgcuauugccggcuuuaucgaaaaugggugggagggaauggucgacgguugguacggcuuccgucaccagaacagugaggggauuggacaggcagcugaucugaaaagcacccaagccgcgauagaccagaucaauggcaaguugaaccgccucauugguaaaacgaacgaaaaguuccaccagaucgagaaggaauuuuccgagguugaagggagaauccaggaucuggagaaauauguggaggacaccaagauugauuuauggucuuacaaugccgaacugcucguagcacuugagaaccaacauacaauagaccugacugauagcgaaaugaauaaauuguucgagaagaccaaaaagcagcuaagggaaaacgcugaggacaugggcaauggaugcuuuaagaucuaucacaaaugugauaacgccugcauuggcucaauccggaaugggacauacgaccaugauguguaccgagacgaggcucugaacaaucgcuuccagauuaagggagucgaacucaaaagugguuauaaggacuggauccuguggauauccuuugccaucagcugcuuccuucuguguguggcauugcucggcuuuauuaugugggccugccagaaagggaacaucagauguaauauuugcaucuga

SEQ ID NO: 128868 - RNA, 1701 nt, Artificial Sequence; identical to SEQ ID NO: 123944
  derived and/or modified sequence opt3 from hemagglutinin__InfluenzaA__AEI54413

SEQ ID NO: 128869 - RNA, 1701 nt, Artificial Sequence; identical to SEQ ID NO: 122297
  derived and/or modified sequence opt3 from hemagglutinin__InfluenzaA__AEI54424

SEQ ID NO: 128870 - RNA, 1701 nt, Artificial Sequence
  derived and/or modified sequence opt3 from hemagglutinin__InfluenzaA__AEI54446
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcaauagcccacaccagauccuagacggugagaacuguacccucauagaugcucugcuuggcgacccgcagugcgauggguuucaaaauaaaaagugggaccuguucguggaaagauccaaagcccauucuaacuguuaucccuacgaugucccugacuaugcaucguugaggucacucguggccagcaguggaacucuggaguuuaauaacgaguccuucaauuggacaggcguuacccagaacgguacgucuagcgcuugcauccggcgcuccaauaacucauuuuucagucgacugaauuggcucacucacuuaaacuuuaaguacccagcacugaacgugaccaugcccaauaacgaacaguucgauaaacuuuauauuuggggaguccaucacccugggacagacaaggaucagaucuuuuuguacgcccaagcugccggccguauuacugugagcaccaagagaucucagcaggcgguaaucccaaauauaggcuccaggccccggguucgcaacauuccuucaagagugagcaucuauuggacaauugucaaaccaggggacauccugcuaaucaauaguaccggaaaccucauugcaccgagggguuacuucaagauacggucuggcaaauccagcaucaugcgcucggaugcccccauugggaaguguaauucugcuugcaucacgccuaacggauccauaccaaaugacaagcccuuucagaacgugaaucgaauuacuuacggcgccuguccuagauaugugaaacaaaacacacugaaacuugcaaccgguaugaggaaugucccagagaagcagacucgggggaucuucggagcuaucgccggcuuuauugaaaacggcugggaggggaugguugacggaugguacgguuuccgucaccaaaauucagagggccgcgggcaggcggccgaucugaagaguacacaggcagcuaucgaccagauuaacggaaaauugaacagacucauaggcaagaccaaugaaaaauuccaucagaucgagaaggaauuuagcgagguggaagguaggauucaagaucuggagaaguauguagaggacacgaaaaucgauuuaugguccuacaacgccgaacugcucguggcucuugagaaucagcacaccaucgaccugacagauucugaaaugaacaaguuguucgagaaaacuaagaaacagcuacgggaaaaugccgaggacauggggaacggcugcuuuaagauuuaucauaagugugauaaugcaugcauaggaagcauccgaaacggcaccuacgaccacgaugucuaucgcgacgaggcccugaauaacagauuccagauuaaagggguggaacucaagucaggauacaaagacuggauccuguggauuaguuuugcuaucuccugcuuccuucuguguguugcguugcucgguuuuauaaugugggcaugccaaaagggcaauaucagguguaacauuugcaucuga

SEQ ID NO: 128871 - RNA, 1701 nt, Artificial Sequence
  derived and/or modified sequence opt3 from hemagglutinin__InfluenzaA__AEI54457
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauaggcagcauccgaaacgggaccuacgaccacgaugucuaucgcgacgaggcccugaauaacagauuccagauuaaaggaguggagcucaagucagguuacaaagacuggauccuguggauuaguuuugcuaucuccugcuuccuucuguguguugcguugcucggcuuuauaaugugggcaugccaaaaggggaauaucagguguaacauuugcaucuga

SEQ ID NO: 128872 - RNA, 1701 nt, Artificial Sequence; identical to SEQ ID NO: 127549
  derived and/or modified sequence opt3 from hemagglutinin__InfluenzaA__AEI54468

SEQ ID NO: 128873 - RNA, 1701 nt, Artificial Sequence; identical to SEQ ID NO: 127549
  derived and/or modified sequence opt3 from hemagglutinin__InfluenzaA__AEI54479

SEQ ID NO: 128874 - RNA, 1701 nt, Artificial Sequence; identical to SEQ ID NO: 128871
  derived and/or modified sequence opt3 from hemagglutinin__InfluenzaA__AEI54490

SEQ ID NO: 128875 - RNA, 1701 nt, Artificial Sequence; identical to SEQ ID NO: 128870
  derived and/or modified sequence opt3 from hemagglutinin__InfluenzaA__AEI54501

SEQ ID NO: 128876 - RNA, 1701 nt, Artificial Sequence
  derived and/or modified sequence opt3 from hemagglutinin__InfluenzaA__AEI59979
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcauucggcgcagcaacaauuccuuuuucucacgacugaacuggcucacucauuuaaaguuuaaguauccagcacugaaugugaccaugcccaacaacgagcaguucgacaaacuuuacaucuggggaguccaccauccuggcacagauaaugaccagaucuuuuuguaugcccaagcuaguggccguauuacugugagcaccaagagaucucagcagacaguaauaccaaacauuggguccaggccccggguucgcaauaucccuucaagaauuagcaucuacuggaccaucgugaaaccaggagauauucugcuaauaaacaguacggguaaucucaucgccccgaggggcuacuucaagauucggucugggaaauccagcaucaugcgcucggacgcgcccauaggaaaguguaacucugaaugcauuacuccuaauggcuccaucccaaacgacaagcccuuucagaaugucaaccgaaucacauauggugcauguccuagauacgugaaacaaaauacccugaaacuugccacugggaugaggaacgugccagagaaacagacacggggaauuuucggcgcuaucgccggcuuuauugaaaaugggugggagggaauggucgaugguugguauggcuuccgucaccagaacucagaggggcgcggacaagcagcugaccugaagaguacccaggccgcgauagaucagaucaauggcaaauugaacagacucauugaaaagacgaacgagaaauuccaccagaucgaaaaggaguuuagcgaaguugaggguaggauccaagaccuggagaaguacguggaagauaccaaaauugacuuaugguccuauaaugccgagcugcucguagcacuugaaaaccagcauacaauagaucugacugacucugagaugaauaaguuguucgaaaagaccaagaaacagcuacgggagaacgcugaggauauggggaauggcugcuuuaagaucuaccacaagugugacaacgccugcauuggaagcauccgaaauggcacauaugaucaugacguguaccgcgacgaagcucugaacaauagauuccagauuaaaggggucgagcucaagucaggauacaaagauuggauccuguggauaaguuuugccaucuccugcuuccuucuguguguggcauugcucgguuuuauuaugugggccugccaaaagggcaacaucagguguaauauuugcaucuga

SEQ ID NO: 128877 - RNA, 1698 nt, Artificial Sequence; identical to SEQ ID NO: 127973
  derived and/or modified sequence opt3 from hemagglutinin__InfluenzaA__AEI59990

SEQ ID NO: 128878 - RNA, 1698 nt, Artificial Sequence; identical to SEQ ID NO: 127975
  derived and/or modified sequence opt3 from hemagglutinin__InfluenzaA__AEI60001

SEQ ID NO: 128879 - RNA, 1701 nt, Artificial Sequence
  derived and/or modified sequence opt3 from hemagglutinin__InfluenzaA__AEI60012
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccgguccucaaacaauagcuuuuucagucgccugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaggcuucuggccgaauuacuguguccaccaagcguucacaacagacaguaaucccaaacauagggagcagacccaggguucggaauauuccuagucgcaucucuauuuacuggaccaucgugaaaccaggagauauccugcuaauuaacuccacggguaaucucauagccccgagaggcuacuucaagaucaggagcgggaaaucgucuauuaugcgguccgacgcgcccaucggaaaguguaacucagaaugcauaacuccuaauggcaguauuccaaacgacaagcccuuucagaaugucaaccgcaucacauauggugcauguccucgauacgugaaacaaaauacccugaaacuugccacugggaugagaaacgugccagagaagcagacaaggggaaucuucggcgcuauugccggcuuuaucgaaaaugggugggagggaauggucgaugguugguauggcuuccggcaccagaacagcgaggggcguggacaagcagcugaccugaaguccacccaggccgcgauugaucagauaaauggcaaauugaaccgccucaucgguaagacgaacgaaaaauuccaccagauugagaaggaauuuucugagguugaagggaagauccaagaccuggagaaauacguggaggauaccaagaucgacuuauggagcuauaaugccgaacugcucguagcacuugagaaccagcauacaauugaucugacugacucagaaaugaauaaauuguucgagaagaccaaaaagcagcuaagagaaaacgcugaggauaugggcaauggaugcuuuaagauauaccacaaaugugacaacgccugcaucggcaguauuaggaaugggacauauaaccaugauguguaccgggacgaggcucugaauaaccgauuccagaucaagggagucgaacucaaauccgguuacaaggacuggauucuguggaucagcuuugccauaucuugcuuccuucuguguguggcauugcucggcuuuaucaugugggccugccaaaaagggaauauucgcuguaacaucugcauuuga

SEQ ID NO: 128880 - RNA, 1701 nt, Artificial Sequence; identical to SEQ ID NO: 124450
  derived and/or modified sequence opt3 from hemagglutinin__InfluenzaA__AEI60023

SEQ ID NO: 128881 - RNA, 1701 nt, Artificial Sequence
  derived and/or modified sequence opt3 from hemagglutinin__InfluenzaA__AEI60034
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaacaauucauuuuucagucgacugaacuggcucacucauuuaaaguuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgagugcauaacuccuaacggcucaauuccaaaugacaagcccuuucagaacgucaaucgaaucacauauggugcauguccuagauacgugaaacaaaacacccugaaacuugccacugggaugaggaaugugccagaaaaacagacacggggaaucuucggcgcuauugccggcuuuaucgagaacgggugggaaggaauggucgaugguugguauggcuuccgucaccagaauagugaggggcgcggacaagcagcugaccuuaagagcacccaggccgcgauugaucagauaaacggcaaauugaauagacucaucgguaagacgaacgagaaguuccaccagauugaaaaagaguuuuccgaaguugaggggaggauccaagaccuggaaaaguacguggaggauaccaaaaucgacuuauggucuuauaacgccgagcugcucguagcacuugaaaaucagcauacaauugaucugacugacagcgagaugaacaaguuguucgaaaagaccaagaagcagcuacgggagaaugcugaagauaugggcaacggaugcuuuaaaauauaccacaagugugacaaugccugcaucggcucaauucgaaacgggacauaugaucaugacguguaccgcgacgaggcucugaauaacagauuccagaucaaaggagucgagcucaagagugguuacaaagauuggauucuguggaucuccuuugccauaagcugcuuccuucuguguguggcauugcucggcuuuaucaugugggccugccaaaaggggaauauuagguguaacaucugcauuuga

SEQ ID NO: 128882 - RNA, 1701 nt, Artificial Sequence
  derived and/or modified sequence opt3 from hemagglutinin__InfluenzaA__AEI60045
augaagaccaucauugcccugagcuacauacucugccuuguguucgcucagaaacugcccggcaacgacaauuccacagcaacuuuguguuuagggcaccaugccgucccuaacggaacgaucguuaagaccauuaugaaugaucaaaucgaggugacaaacgcgacugaacugguacagucuucaaguaccggugagauuugcgacagcccacaccagauccuagauggcaaaaauuguacacucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacccuggaguuuaacaaugaauccuucaacuggacugguguuacacagaaugggaccucuagcgcuugcauccggcgcuccaagaacucauuuuucagucgacugaauuggcucacgcauuuaaacuuuaaauauccagcacugaaugugacuaugcccaacaacgagcaguucgacaaacuuuacauuuggggaguccaccauccuggcaccgauaaagaccagaucuuuuuguaugcccaagcuagcggccguauuacagugucuacuaagagaucccagcagaccgccaucccaaauauaggguacaggccccggguacgcaacauuccuucaagaaucagcauuuacuggacaaucguuaaaccaggagauauccugcuaauuaauaguaccgguaaccucauagcgccgaggggcuauuucaagauccggucugggaaguccagcauuaugcgcucggacgcacccaucggaaaauguaauucugagugcauaacgccuaacggcuccauuccaaaugacaagcccuuucagaacgugaaucgaaucacuuacggugccuguccuagauaugucaaacaaaacacacugaaacuugcuaccgggaugaggaaugugccagaaaagcagacucggggaaucuucggcgccauugcaggcuuuaucgagaacgggugggaaggaaugguggaugguugguacggcuuccgucaccaaaauucagaggggcgcggacaggcugccgaccugaagaguacacaggcggccauugaucagauaaacggcaaauugaauagacucaucgguaagaccaacgagaaguuccaccagauugaaaaagaguuuagcgaagucgaggggaggauccaagaccuggaaaaguauguugaggauacgaaaaucgacuuaugguccuacaacgcagagcugcucguggcucuugaaaaucagcauaccauugaucugacagacucugagaugaacaaguuguucgaaaagacuaagaagcagcuacgggagaaugccgaagauaugggcaacggaugcuuuaaaauauaucacaagugugacaaugcuugcaucggcagcauucgaaacgggaccuacgaucaugacguauaccgcgacgaggcccugaauaacagauuccagaucaaaggaguggagcucaagucagguuauaaagauuggauucuguggaucaguuuugcaauauccugcuuccuucugugugucgccuugcucggcuuuaucaugugggcuugccaaaaggggaauauuagguguaacaucugcauuuga

SEQ ID NO: 128883 - RNA, 1701 nt, Artificial Sequence
  derived and/or modified sequence opt3 from hemagglutinin__InfluenzaA__AEI60086
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauacuuguauggaaagcgugaagaacggcaccuacgacuauccuaaauacucagaagaggccaagcugaauagagaagagauugauggggucaaacuugagaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 128884 - RNA, 1701 nt, Artificial Sequence
  derived and/or modified sequence opt3 from hemagglutinin__InfluenzaA__AEI60109
augaagaccacaaucgcccugagcuacauucucugccuuguguucgcucagaaacugcccggcaacgacaauuccacugcaacguuguguuuagggcaccaugccgucccuaacggaacccugguuaagacaauaacuaaugaucaaaucgaggugaccaacgcgacagaacuuguacaaaauucuucaaccgguagaauuugcgacaguccacaccagauccucgauggcgagaacuguacucugauugacgcucuacugggggauccgcauugcgacggauuucagaauaaagaaugggauuuguucguggagaggagcaaggccuauuccaacuguuaccccuauaaugucccugacuacgugucucuccggucgcugguugcaucaagcggcacacuggaauuuaacaaugagaguuucaacuggaccgguguggcccaggauggguccucuuaugcuugcaaacgccgaagcaauaaguccuuuuucucacgucucaacugguuacaccagcugaauuacaaguauccagcacuuaacgucacgaugcccaacaaugagaacuuugacaaauuguacaucuggggagugcaucacccuggcacugauagugaccagauaagccuguacgcccaggcuucuggcagaguaaccguuuccacaaagaggucacaacagacugugaucccaaauauuggguaucggcccuggguccgcggagugagcaguaucauuucuaucuacuggaccauagugaaaccuggugauauucuacucaucaacuccacaggcaaucugauugccccaagaggguauuucaagaucaggagcggaaaaucgucuaucaugcgguccgacgcgccgauuggcaaguguaacucagaaugcauaacccccaaugguaguaucccuaacgacaagccauuucagaaugucaaccgcauuacguacgggcccuguccucgauauguuaaacagaauacucuuaagcuggcaacaggaaugagaaacgugccagagaaacaaaccaggggcaucuucggcgccauagcuggguuuauugaaaauggaugggaggguaugaaggauggcugguacggguuccggcaccagaacagcgagggaacuggccaggccgcagacaucaaauccacacaagcugccaucaaucagauuaacgguaaguugaaccgucucaucgagaaaaccaaugaaaaguuucaucagauugaaaaggaguucucugaaguagaggggcgcauacaggaucuggagaaauauguggaagacacgaagaucgauuuauggagcuacaacgcggagcugcucgucgcccuugaaaaucaacacaccauugaccugacagauucagagaugaacaaauuguucgaaagaacuaagaaacagcuaagggagaaugcagaggacaugggcaacggaugcuuuaagaucuaccauaagugugauaauaccugcaucggcaguauucggaacgggacauaugaccacgauguguaccgagacgaagcucugaauaaccgcuuccacauaaaaggaguugagcucaaguccgguuauaaagacuggauccuguggauuagcuuugccacuucuugcuuccuucuguguaucguguugcucggcuuuauuaugugggcuugccagaaggggaauaucagauguaacauaugcaucuga

SEQ ID NO: 128885 - RNA, 1701 nt, Artificial Sequence
  derived and/or modified sequence opt3 from hemagglutinin__InfluenzaA__AEI86734
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuaacucggacaauggaacuugcuauccaggcgauuuuauugacuacgaggagcucagggagcagcugucaagcgucaguuccuucgaacgguuugagaucuucccgaagacaucuagcuggcccaaccacgauuccaauaagggugugaccgccgcuuguccucaugcaggggccaaaucauuuuaucgcaaccugauuuggcucguaaagaaaggaaauaguuacccaaaguuaagcaaaucuuauaucaacgacaagggcaaggaaguucuggugcuuuggggcauacaccaccccuccacgucagcugaucaacagagcuuguaccagaaugccgacacuuacgucuucguggggaccagucgauauucuaaaaaguuuaaaccugagaucgcgauucguccaaaggugagagaucaggagggaaggaugaacuacuauuggacacuggucgaacccggugacaaaaucacuuucgaggcaaccggcaaccuaguugugccucgguacgccuuugcuauggaacgcaaugccggguccggaauuaucauaagcgauacaccaguacaugacugcaacaccacgugucaaacuccgaagggcgcaauuaauacaucgcuccccuuccagaacauccacccuauuaccaucgguaaaugcccaaaguaugugaagucuacuaaacugagacuugcuacagggcugaggaauguccccuccauccagucacggggauuguuuggcgccauugcgggcuucauagaagggggauggaccgguaugguggacggcugguacggguaucaucaccagaacgaacaaggaaguggcuacgccgcagaucucaagagcacgcagaaugcuaucgacgagauuaccaacaaaguuaauuccgugaucgagaagaugaacacacaguuuacugccgucgguaaagaguucaaucaccuggaaaagcgcauagaaaacuuaaauaagaaaguggaugacggguuccuggauauuuggaccuacaacgcugagcuccuuguacuguuggaaaaugagcgaacacuagacuaucaugauucuaacguuaagaaccuguacgagaaagugagaagccagcucaagaauaacgccaaagaaaucggcaauggauguuuugaguucuaucacaagugcgacaacacuuguauggaaucagucaagaauggcaccuacgauuauccuaaauacagugaggaagcaaagcugaacagggaggagaucgacggggugaaacuugaauccacacggauuuaucaaauccuggccauuuacagcaccgucgcuucuucauuggugcucguugugagucugggagcgaucagcuuuuggaugugcuccaaugguucuuuacagugccguauauguauuuga

SEQ ID NO: 128886 - RNA, 1701 nt, Artificial Sequence
  derived and/or modified sequence opt3 from hemagglutinin__InfluenzaA__AEI86764
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaaaagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 128887 - RNA, 1701 nt, Artificial Sequence; identical to SEQ ID NO: 128886
  derived and/or modified sequence opt3 from hemagglutinin__InfluenzaA__AEI86774

SEQ ID NO: 128888 - RNA, 1701 nt, Artificial Sequence
  derived and/or modified sequence opt3 from hemagglutinin__InfluenzaA__AEI86784
augaaggugauccuggucguucuccuuuacaccuucgccacagcuaacgcagacacucugugcauuggcuaucacgccaauaacagcacggauaccguggacacaguauuggagaagaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggaacucagggagcagcugagcagugucuccucuuucaagcgguuugaaauuuucccgaagacaagcuccuggcccaaucacgauucaaacaaaggugugaccgcagccuguccucaugcuggggcaaagaguuuuuauaaaaaucugaucuggcucguaaagaaaggaaacagcuacccaaaguuaucuaaguccuauauaaaugacaaaggcaaggagguucuggugcuuuggggcauccaccaccccucaacgagcgccgaucaacagaguuuguaccagaacgcugacgccuacgucuucguggggacuucucgcuauuccaaaaaguuuaaaccugaaauugcgauccgaccaaaggugcgugaucaggagggaagaaugaauuacuauuggacccuggucgagcccggugacaaaauuacauucgaagcaacuggcaaccuaguugugccuagguacgccuuugcuauggagcggaacgccgggagcggaaucauaauuucggauaccccaguacaugacugcaauacaaccugucaaacgccgaagggcgcaaucaacacuucucuccccuuccagaauauucacccuaucacaaucgguaagugcccaaaauaugugaaguccaccaaacugcgccuugcuacugggcugagaaacguccccucaauucagaguaggggauuguuuggcgccauagcgggcuucaucgaagggggauggacagguaugguggacggcugguacggguaucaucaccagaaugagcaaggaagcggcuacgccgcagaucucaaguccacccagaacgcuauugacaaaaucacgaauaagguuaacucugugauagaaaagaugaauacccaguuuacagccgucgguaaagaguucaaccaccuggagaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgaaaaggugcgaucacagcucaagaacaaugccaaagagaucggcaacggauguuuugaguucuaucacaagugcgacaauacauguauggaaagugucaaaaacggcacuuacgauuauccuaaguacuccgaggaagcaaaacugaauagagaggaaauugacggggugaaacuugagagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 128889 - RNA, 1701 nt, Artificial Sequence
  derived and/or modified sequence opt3 from hemagglutinin__InfluenzaA__AEI86794
augaagaccauccuggugguccuccuuuacacauucgccacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcaauuuuaucgauuacgaggagcucagggagcagcugagcaguguguccucuuucgaacgguuugagauuuucccgaagaccagcuccuggcccgaccacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucuaaguauuccaaaaaguuuaaaccugagauugcgauccgcccaaaggugcgagaucaggagggacguaugaauuacuauuggacacugguggaacccggugacaaaauuacuuucgaggcaaccggcaaccuagucgccccuagauacgcuuuugccauggaaaggaacgcagggagcggaaucauaauuucggauacaccaguucaugacugcaauaccacgugucaaacuccgaagggcgcuaucaacacaucucuccccuuccagaauauucacccuaucaccaucgguaagugcccaaaauaugugaaguccacuaaacugcggcuugccacagggcugcgcaacguacccucaauucagaguagaggauuguuuggcgcgauagccggcuucaucgaagggggauggaccgguaugguggacggcugguacggguaucaucaccagaaugaacaaggaagcggcuacgcagcugaucucaaguccacgcagaacgccauugacaaaaucaccaauaaggucaacucugugauagagaagaugaauacacaguuuacugcuguugguaaagaguucaaccaccuggaaaagaggauugagaauuuaaacaaaaagguggaugacggguuccuggauaucuggaccuacaaugccgaacuccuuguccuguuggagaacgaacggacacuagacuaucaugauagcaaugugaaaaaccuguacgagaagguacgcucacagcucaagaacaaugcaaaagagaucggcaacggauguuuugaguucuaucacaagugcgacaauacuuguauggaaaguguuaaaaacggcaccuacgauuauccuaaguacuccgaagaggccaaacugaaucgagaagagauugacggggugaaacuugagagcacaagaaucuaucaaauucuggcuauauacucuaccgucgcgucaaguuuggugcucgucgugagccugggagcaaucuccuuuuggaugugcucuaacgguucguuacagugcaggauuuguaucuga

SEQ ID NO: 128890 - RNA, 1701 nt, Artificial Sequence
  derived and/or modified sequence opt3 from hemagglutinin__InfluenzaA__AEI86804
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugauguggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacgcguacguguucgucgggacuucucgcuauuccaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacaagauuacgaauaaagugaacucuguuaucgagaagaugaauacccaguuuacagcuguggguaaggaguucaaccaccuggaaaaacggauagagaauuuaaacaagaaagucgaugacggguuccuggauauuuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagaucgacggggucaaacuugagagcaccaggauuuaucaaauccuggcuauuuacucugcgguggcaucaaguuugguccucgugguuagccugggagccauauccuuuuggaugugcucuaacgguucguuacagugccggaucuguauuuga

SEQ ID NO: 128891 - RNA, 1701 nt, Artificial Sequence; identical to SEQ ID NO: 128886
  derived and/or modified sequence opt3 from hemagglutinin__InfluenzaA__AEI86814

SEQ ID NO: 128892 - RNA, 1701 nt, Artificial Sequence
  derived and/or modified sequence opt3 from hemagglutinin__InfluenzaA__AEI86824
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccaggaugccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaauaacgcaaaggagaucggcaacggauguuuugaguucuaucacaaaugcgacaauacauguauggaaagugugaagaacggcacuuacgauuauccuaaauacuccgaagaggccaagcugaauagagaaaagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 128893 - RNA, 1701 nt, Artificial Sequence
  derived and/or modified sequence opt3 from hemagglutinin__InfluenzaA__AEI86834
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauucccgaaaguuuaaaccugagauugcaauccguccaaaggugagagaucaggagggaaggaugaauuacuauuggacccugguggaacccggugacaaaauuacauucgaggccacuggcaaccuagucgcuccucgguacgccuuugcaauggaacgcaacgcugggagcggaaucauaauuucggauaccccaguucaugacugcaauacaaccugucaaacgccgaagggcgccaucaacacuucucuccccuuccagaauauucacccuaucacaaucgguaaaugcccaaaguaugugaaguccaccaaacugagacuugcgacugggcugaggaacguacccucaauucagagucggggauuguuuggcgccauagcaggcuucaucgaagggggauggacagguaugguggacggcugguacggguaucaucaccagaaugaacaaggaagcggcuacgcugccgaucucaaguccacccagaacgcuauugacaaaaucacgaauaaggucaacucugugauagagaaaaugaauacccaguuuacagccguugguaaggaguucaaccaccuggaaaagcgcauugagaauuuaaacaaaaagguggaugacggguuccuggauaucuggacuuacaaugcagaacuccuuguccuguuggagaacgaacgaacccuagacuaucaugauagcaaugugaaaaaccuguacgagaagguaagaucacagcucaaaaacaaugccaaggagaucggcaacggauguuuugaguucuaucacaagugcgacaauacauguauggaaaguguuaaaaacggcacuuacgauuauccuaaguacuccgaagaggcuaaacugaauagggaagagauugacggggugaaacuugagagcacccggaucuaucaaauucuggcgauauacucuacagucgcaucaaguuuggugcucgucgugagccugggagccaucuccuuuuggaugugcucuaacgguucguuacagugccguauuuguaucuga

SEQ ID NO: 128894 - RNA, 1701 nt, Artificial Sequence; identical to SEQ ID NO: 127600
  derived and/or modified sequence opt3 from hemagglutinin__InfluenzaA__AEI86854

SEQ ID NO: 128895 - RNA, 1701 nt, Artificial Sequence
  derived and/or modified sequence opt3 from hemagglutinin__InfluenzaA__AEI86864
augaaggccauccugguggcucuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucaauuacgaggagcucagggagcagcugagcaguguuuccucuuucgaacgguuugagauuuucccgaagacaagcuccuggcccaaccacgacucaaauaagggugugaccgcugcauguccucaugccggggcuaaaaguuuuuauaagaaccugaucuggcucgucaaaaagggaaauagcuacccaaaauuaucuaaguccuauauaaacgauaagggcaaagaagugcugguacuuuggggcauccaccaccccucaacgacugccgaccaacagagcuuguaccagaaugcggaugcauacguuuucguggggaccagucgcuauucuaagaaauuuaagccugagauugccauccgaccaaaaguccgugaccaggagggaagaaugaacuacuauuggacacugguggaacccggugauaagauuacuuucgaggcuaccggcaaccuaguggucccuagguacgccuuugcaauggaacggaaugcuggguccggaaucauaauuagcgacacaccaguucaugauugcaacaccacgugucaaacuccgaaaggcgccaucaauacaucgcuccccuuccagaacauucacccuaucaccaucgguaagugcccaaaguaugugaaaucuacuaagcugcgccuugcgacagggcugagaaauguacccuccauucagucaaggggauuguuuggcgccauagcaggcuucaucgaagggggauggaccgguaugguggacggcugguacggguaucaucaccagaacgaacaaggaaguggcuacgcugccgaccucaaaagcacgcagaaugcuauugauaagaucaccaacaaagucaauuccgugauagagaagaugaacacacaguuuacugccguugguaaggaguucaaucaccuggaaaaacggauugagaacuuaaauaagaaaguggacgauggguuccuggacaucuggaccuacaacgcagaacuccuuguccuguuggagaaugaacgcacacuagauuaucaugacucuaacgugaagaaccuguacgagaaaguacgaaaucagcucaagaacaaugccaaggagaucggcaacggauguuuugaguucuaucacaaaugcgauaauacuuguauggaaagcguuaagaacggcaccuacgacuauccuaaauacucagaagaggcuaagcugaauagagaagagauugauggggugaaacuugagaguacaaggaucuaucaaauucuggcgauauacuccaccgucgcaagcucuuuggugcucgucgugucacugggagccaucaguuuuuggaugugcagcaacgguuccuuacagugccggauuuguaucuga

SEQ ID NO: 128896 - RNA, 1701 nt, Artificial Sequence; identical to SEQ ID NO: 128886
  derived and/or modified sequence opt3 from hemagglutinin__InfluenzaA__AEI86874

SEQ ID NO: 128897 - RNA, 1701 nt, Artificial Sequence
  derived and/or modified sequence opt3 from hemagglutinin__InfluenzaA__AEI86894
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauagcaaugugaagaaccuguacgagaaaguacgaucacagcucaagaacaaugccaaggagaucggcaacggauguuuugaguucuaucacaaaugcgacaauacauguauggaaaguguuaagaacggcacuuacgauuauccuaaauacuccgaagaggcuaagcugaauagagaagagauugacggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 128898 - RNA, 1701 nt, Artificial Sequence
  derived and/or modified sequence opt3 from hemagglutinin__InfluenzaA__AEI86904
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuaccgccgaucaacagagcuuguaccagaacgcugacgccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaucggcaauggauguuuugaguucuaucacaaaugcgacaacaccuguauggaaagcgugaagaauggcacauacgauuauccuaaauacucagaagaggcaaagcugaacagagaagagauugacggggucaaacuugagaguaccaggaucuaucaaauucuggccauauacuccacuguggcuagcucuuugguccucgugguuucacugggagcgaucaguuuuuggaugugcagcaaugguuccuuacagugccggauuuguaucuga

SEQ ID NO: 128899 - RNA, 1701 nt, Artificial Sequence
  derived and/or modified sequence opt3 from hemagglutinin__InfluenzaA__AEI86914
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccacgcuuaucuaaauccuauauaaacgauaagggcaaggaaguacugguucuuuggggcauccaccaccccucaacgacugcugaccaacagagcuuguaccagaaugccgaugcguacguguucgucgggaccagucgauauucuaaaaaguuuaaaccugagauugcaauccguccaaaggugagagaccaggagggaaggaugaacuacuauuggacacugguggaacccggugauaaaauuacuuucgaggccaccggcaaccuagucguuccucgguacgcuuuugccauggaacgcaaugcaggguccggaaucauaauuagcgacacaccagugcaugauugcaacaccacgugucaaacuccgaagggcgcuaucaauacaucgcuccccuuccagaacauucacccuaucaccaucgguaaaugcccaaaguauguaaagucuacuaaacugagacuugccacagggcugaggaaugugcccuccauucagucacggggauuguuuggcgcgauagccggcuucaucgaagggggauggaccgguauggucgacggcugguacggguaucaucaccagaacgaacaaggaaguggcuacgcagcugaccucaagagcacgcagaaugccauugauaaaaucaccaacaagguaaauuccguuauagagaaaaugaacacacaguuuacugcuguggguaaggaguucaaucaccuggaaaagcgcauugagaacuuaaauaaaaaggucgacgauggguuccuggacaucuggaccuacaacgccgaacuccuugugcuguuggagaaugaacgaacacuagauuaucaugacucuaacgugaaaaaccuguacgagaagguuagaaaucagcucaaaaacaaugcaaaggagaucggcaacggauguuuugaguucuaucacaagugcgauaauacuuguauggaaagcgugaaaaacggcaccuacgacuauccuaaguacucagaagaggccaaacugaauagggaagagauugauggggucaaacuugagaguacacggaucuaucaaauucuggcuauauacuccaccguggcgagcucuuugguccucgugguuucacugggagcaaucaguuuuuggaugugcagcaacgguuccuuacagugccguauuuguaucuga

SEQ ID NO: 128900 - RNA, 1701 nt, Artificial Sequence
  derived and/or modified sequence opt3 from hemagglutinin__InfluenzaA__AEI86924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucaucaaaaagggaaacagcuacccaaaauuaucuaaguccuauauaaaugauaagggcaaagaaguacugguucuuuggggcauucaccaccccucaacgacugcugaccaacagagcuuguaccagaacgccgaugcguacguguucgucgggaccagucgcuauucuaagaaauuuaagccugagaucgcagugcgaccaaaagugcgugaccaggagggaagaaugaauuacuauuggacacuggucgaacccggugauaagauuacuuucgaggccaccggcaaccuaguugugccuagguacgcuuuugccauggaacggaacgcaggguccggaaucauaauuagcgacacaccaguacaugauugcaauaccacgugucaaacuccgaaaggcgcuaucaacacaucgcuccccuuccagaauauucacccuaucaccaucgguaagugcccaaaguaugugaaaucuacuaagcugcgccuugccacagggcugagaaacguccccuccauucagucaaggggauuguuuggcgcgauagccggcuucaucgaagggggauggaccgguaugguggacggcugguacggguaucaucaccagaaugaacaaggaaguggcuacgcagcugaccucaaaagcacgcagaacgccauugauaagaucaccaauaaaguuaacuccgugauagagaagaugaauacacaguuuacugcugucgguaaggaguucaaccaccuggaaaaacggauugagaauuuaaacaagaaaguggacgauggguuccuggacaucuggaccuacaaugccgaacuccuuguacuguuggagaacgaacgcacacuagauuaucaugacucuaauguuaagaaccuguacgagaaagugcgaaaccagcucaagaauaacgcaaaggagaucggcaauggauguuuugaguucuaucacaaaugcgauaacacuuguauggaaagcgucaagaauggcaccuacgacuauccuaaauacucagaagaggccaagcugaacagagaagagauugauggggugaaacuugagaguacaaggaucuaucaaauucuggcuauauacuccaccgucgcgagcucuuuggugcucguugugucacugggagcaaucaguuuuuggaugugcagcaaugguuccuuacagugccggauuuguaucuga

SEQ ID NO: 128901 - RNA, 1701 nt, Artificial Sequence; identical to SEQ ID NO: 128886
  derived and/or modified sequence opt3 from hemagglutinin__InfluenzaA__AEI86934

SEQ ID NO: 128902 - RNA, 1701 nt, Artificial Sequence; identical to SEQ ID NO: 127600
  derived and/or modified sequence opt3 from hemagglutinin__InfluenzaA__AEI86944

SEQ ID NO: 128903 - RNA, 1701 nt, Artificial Sequence
  derived and/or modified sequence opt3 from hemagglutinin__InfluenzaA__AEI86964
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgaugcguacgucuucguggggaccagucgcuauucuaagaaauuuaagccugagauugcagugcgaccaaaaguccgugaccaggagggaagaaugaauuacuauuggacacugguugaacccggugauaagaucacuuucgaggccaccggcaaccuagugguaccuagguacgcuuuugccauggaacggaacgcaggguccggaauuaucauaagcgacacaccagugcaugauugcaauaccacgugucaaacuccgaaaggcgcuauuaacacaucgcuccccuuccagaauauccacccuauuaccaucgguaagugcccaaaguaugucaaaucuacuaagcugcgccuugccacagggcugagaaacgugcccuccauccagucaaggggauuguuuggcgcgauugccggcuucauagaagggggauggaccgguaugguugacggcugguacggguaucaucaccagaaugaacaaggaaguggcuacgcagcugaccucaaaagcacgcagaacgccaucgauaagauuaccaauaaagugaacuccgucaucgagaagaugaauacacaguuuacugcuguggguaaggaguucaaccaccuggaaaaacggauagagaauuuaaacaagaaaguagacgauggguuccuggacauuuggaccuacaaugccgaacuccuuguucuguuggagaacgaacgcacacuagauuaucaugacucuaaugugaagaaccuguacgagaaaguccgaaaccagcucaagaauaacgcaaaggagaucggcaauggauguuuugaguucuaucacaaaugcgauaacauguguauggaaagcgugaagaauggcacuuacgacuauccuaaauacucagaagaggccaagcugaacagagaagagaucgauggggucaaacuugagaguaccaggauuuaucaaauccuggcuauuuacuccacaguggcgagcucuuugguucucgugguaucacugggagcaauaaguuuuuggaugugcagcaaugguuccuuacagugccggaucuguauuuga

SEQ ID NO: 128904 - RNA, 1701 nt, Artificial Sequence; identical to SEQ ID NO: 127842
  derived and/or modified sequence opt3 from hemagglutinin__InfluenzaA__AEI86974

SEQ ID NO: 128905 - RNA, 1701 nt, Artificial Sequence; identical to SEQ ID NO: 127600
  derived and/or modified sequence opt3 from hemagglutinin__InfluenzaA__AEI86984

SEQ ID NO: 128906 - RNA, 1701 nt, Artificial Sequence; identical to SEQ ID NO: 127600
  derived and/or modified sequence opt3 from hemagglutinin__InfluenzaA__AEI86994

SEQ ID NO: 128907 - RNA, 1701 nt, Artificial Sequence
  derived and/or modified sequence opt3 from hemagglutinin__InfluenzaA__AEI87004
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcaauuuuaucgauuacgaagaacucagagagcagcugagcaguguguccucuuucgaaagguuugagauuuucccgaagacaagcuccuggcccgaccacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagggguuguaccagaacgccgacgcguacguguucgucggaaccagucgguauucuaaaaaguuuaaaccugagauugcaauccgcccaaaggugcgagaucaggagggucguaugaauuacuauuggacucugguggaacccggcgacaaaauuacauucgaggccacugggaaccuagucgcuccuagauacgccuuugcaauggaaaggaacgcuggauccggcaucauaauuagcgauaccccaguucaugacugcaauacaaccugucaaacgccgaagggugccaucaacacuucgcuccccuuccagaauauucacccuaucacaaucgggaagugcccaaaauaugugaagucuaccaaacugcggcuugcgacuggacugcgcaacguacccuccauucagucaagaggcuuguuuggcgccauagcaggguucaucgagggagguuggacaggcaugguggacgggugguacggauaucaucaccagaaugaacaaggcagugguuacgcugccgaucucaagagcacccagaacgcuauugacaaaaucacgaauaaggucaacuccgugauagagaagaugaauacccaguuuacagccguugggaaagaguucaaccaccuggaaaagaggauugagaauuuaaacaaaaagguggaugacggcuuccuggauaucuggacuuacaaugcagaacuccuuguccuguuggagaacgaacggacccuagacuaucaugauucuaaugugaaaaaccuguacgagaagguacgcagccagcucaagaacaaugccaaagagaucggaaacggcuguuuugaguucuaucacaagugcgacaauacauguauggagucaguuaaaaacgggacuuacgauuauccuaaguacagugaagaggcuaaacugaaucgagaagagauugacggagugaaacuugaguccaccagaaucuaucaaauucuggcgauauacagcacagucgcaucuucauuggugcucgucgugagucugggugccaucagcuuuuggaugugcuccaacggcucuuuacagugcaggauuuguaucuga

SEQ ID NO: 128908 - RNA, 1701 nt, Artificial Sequence
  derived and/or modified sequence opt3 from hemagglutinin__InfluenzaA__AEI87014
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccggggaagccaagcugaauagagaggaaauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 128909 - RNA, 1701 nt, Artificial Sequence
  derived and/or modified sequence opt3 from hemagglutinin__InfluenzaA__AEI87034
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuauugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacagcaacgugaagaaucuguacgagaaaguacgaucacagcucaagaacaacgcaaaggagauuggcaauggauguuuugaguucuaucacaaaugcgauaacacauguauggaaaguguuaagaauggcacuuacgacuauccuaaauacuccgaagaggccaagcugaacagagaagagaucgauggggugaaacuugagagcaccaggauuuaucaaauacuggcuaucuacucuacagucgcgucaaguuuggugcucgucgugagccugggagcaauuuccuuuuggaugugcucuaaugguucguuacagugccggaucuguaucuga

SEQ ID NO: 128910 - RNA, 1701 nt, Artificial Sequence; identical to SEQ ID NO: 127600
  derived and/or modified sequence opt3 from hemagglutinin__InfluenzaA__AEI87044

SEQ ID NO: 128911 - RNA, 1701 nt, Artificial Sequence; identical to SEQ ID NO: 125849
  derived and/or modified sequence opt3 from hemagglutinin__InfluenzaA__AEI87054

SEQ ID NO: 128912 - RNA, 1701 nt, Artificial Sequence
  derived and/or modified sequence opt3 from hemagglutinin__InfluenzaA__AEI87064
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaucggcaauggauguuuugaguucuaucacaaaugcgacaacaccuguauggaaagcgugaagaauggcacauacgauuauccuaaauacucagaagaggcaaagcugaacagagaagagauugacggggucaaacuugagaguaccaggaucuaucaaauucuggccauauacuccacugcugcgagcucuuuggugcucgucgugucacugggagcaaucaguuuuuggaugugcagcaaugguuccuuacagugccggauuuguaucuga

SEQ ID NO: 128913 - RNA, 1701 nt, Artificial Sequence
  derived and/or modified sequence opt3 from hemagglutinin__InfluenzaA__AEI87074
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauuaauuacgaggagcucagggagcagcugagcaguguguccucuuucgaacgguuugagaucuucccgaagaccagcuccuggcccaaccacgacucaaauaagggugucacggccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacuaccgcugaccaacagagcuuguaccagaaugccgaugcguacguguucgucgggacaagucgcuauucuaagaaauuuaagccugagaucgcaauucgaccaaaagugcgugaccaggagggaagaaugaacuacuauuggacucugguggaacccggugauaagaucaccuucgaggccacaggcaaccuagucguuccuagguacgcuuuugccauggaacggaaugcaggguccggaauuaucauaagcgacaccccagugcaugauugcaacacgacuugucaaacaccgaaaggcgcuauuaauaccucgcuccccuuccagaacauccacccuauuacuaucgguaagugcccaaaguauguaaaaucuacaaagcugcgccuugccaccgggcugagaaaugugcccuccauccagucaaggggauuguuuggcgcgauugccggcuucauagaagggggauggacggguauggucgacggcugguacggguaucaucaccagaacgaacaaggaaguggcuacgcagcugaccucaaaagcacccagaaugccaucgauaagauuacaaacaaaguuaauuccgugaucgagaagaugaacacucaguuuaccgcuguggguaaggaguucaaucaccuggaaaaacggauagagaacuuaaauaagaaagucgacgauggguuccuggacauuuggacauacaacgccgaacuccuugugcuguuggagaaugaacgcacucuagauuaucaugacucuaacguaaagaaccuguacgagaaaguucgaaaucagcucaagaacaaugcaaaggagaucggcaacggauguuuugaguucuaucacaaaugcgauaauaccuguauggaaagcgugaagaacggcacauacgacuauccuaaauacucagaagaggccaagcugaauagagaagagaucgauggggucaaacuugagaguaccaggauuuaucaaauccuggcuauuuacuccacuguggcgagcucuuugguccucgugguuucacugggagcaauaaguuuuuggaugugcagcaacgguuccuuacagugccggaucuguauuuga

SEQ ID NO: 128914 - RNA, 1701 nt, Artificial Sequence
  derived and/or modified sequence opt3 from hemagglutinin__InfluenzaA__AEI87094
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacaccgggagcggaaucauaauuucggacacaccagugcaugacugcaacaccacgugucaaacuccgaaaggcgcaaucaauacaucucuccccuuccagaacauucacccuaucaccaucgguaagugcccaaaguauguaaaauccacuaagcugcgccuugcuacagggcugagaaaugugcccucaauucagaguaggggauuguuuggcgccauagcgggcuucaucgaagggggauggaccgguauggucgauggcugguacggguaucaucaccagaacgaacaaggaagcggcuacgccgcagaccucaaauccacgcagaaugcuauugauaagaucaccaacaaaguuaauucugugauagagaagaugaacacacaguuuacugccguggguaaggaguucaaucaccuggaaaaacggauugagaacuuaaauaagaaagucgacgauggguuccuggacaucuggaccuacaacgcugaacuccuugugcuguuggagaaugaacgcacacuagauuaucaugacagcaacguaaagaaucuguacgagaaaguucgaucacagcucaagaacaacgccaaggagaucggcaauggauguuuugaguucuaucacaaaugcgauaacacuuguauggaaagugugaagaauggcaccuacgacuauccuaaauacuccgaagaggcaaagcugaacagagaaaagauugaugggaucaaacuugagagcacaaggauuuaucaaauacuggccaucuacucuaccgucgcuucaaguuuggugcucgucgugagccugggagcgauuuccuuuuggaugugcucuaaugguucguuacagugccggaucuguaucuga

SEQ ID NO: 128915 - RNA, 1701 nt, Artificial Sequence; identical to SEQ ID NO: 128914
  derived and/or modified sequence opt3 from hemagglutinin__InfluenzaA__AEI87104

SEQ ID NO: 128916 - RNA, 1698 nt, Artificial Sequence; identical to SEQ ID NO: 125642
  derived and/or modified sequence opt3 from hemagglutinin__InfluenzaA__AEI91963

SEQ ID NO: 128917 - RNA, 1701 nt, Artificial Sequence; identical to SEQ ID NO: 125849
  derived and/or modified sequence opt3 from hemagglutinin__InfluenzaA__AEI91977

SEQ ID NO: 128918 - RNA, 1701 nt, Artificial Sequence; identical to SEQ ID NO: 127373
  derived and/or modified sequence opt3 from hemagglutinin__InfluenzaA__AEI91978

SEQ ID NO: 128919 - RNA, 1701 nt, Artificial Sequence; identical to SEQ ID NO: 126315
  derived and/or modified sequence opt3 from hemagglutinin__InfluenzaA__AEI91998

SEQ ID NO: 128920 - RNA, 1701 nt, Artificial Sequence
  derived and/or modified sequence opt3 from hemagglutinin__InfluenzaA__AEI91999
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaacgugaccaugcccaauaacgagcaguucgauaaguuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagaaucaguauuuacuggacaaucgugaaaccaggagacauccugcuaauuaauucuaccgguaaccucauagcgccgaggggcuacuucaagauccgguccgggaaaagcucgauuaugcgcucugaugcacccaucggaaaguguaauuccgaaugcauaacgccuaacggcucaauucugaaugacaagccauuucagaacgucaaucgaaucacuuauggugccugucccagauacgugaaacaaaacacacuuaagcuggcuaccgggaugaggaaugugccugagaaacagacucggggaaucuucggcgccauugcaggcuuuaucgaaaacgggugggagggaauggucgacgguugguauggcuuccgucaccagaauagugaggggcgcggacaagcugccgaucuuaagagcacacaggcggccauugaccagauaaacggcaaacucaacagacugaucgguaagaccaaugaaaaauuccaccagauugagaaggaauuuuccgagguugaagggaggauccaagauuuagagaaguacguggaggacacgaaaaucgaucuguggucuuauaacgcagaacuccuuguagcucuggagaaucagcauaccauugacuugacagauagcgaaaugaacaagcuauucgagaaaacuaagaaacagcugcgggaaaaugccgaggacaugggcaacggaugcuuuaagauauaccacaagugugauaaugcuugcaucggcucaauucgaaacgggaccuaugaccaugauguguaccgcgacgaggcccucaauaacagauuccagaucaaaggagucgaacugaagagugguuacaaagacuggauucuuuggaucuccuuugcaauaagcugcuuccuguuguguguggcccuccugggcuuuaucaugugggcuugccaaaaggggaauauuagguguaacaucugcauuuga

SEQ ID NO: 128921 - RNA, 1698 nt, Artificial Sequence
  derived and/or modified sequence opt3 from hemagglutinin__InfluenzaA__AEI92018
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgccgaccagaaaacgcuguaccauacugagaaugcuuacgucuccguggugucaagccacuauagucgcaaguucacccccgaaauagcaaagcgaccuaaaguccgugaucaggaggggagaaucaacuacuauuggacacuucuggagccaggagacacuauuaucuuugaagccaaugguaacuugauugcuccgagguacgccuucgcgcucucucggggcuuuggguccggaaucauaaauagcaacgcacccauggauaagugugacgccaaaugccagaccccucaaggcgcuauuaauucgucucugccauuccagaacguucaucccgugacaaucggugaguguccuaaguauguacgcuccgccaaauuaagaauggugaccgggcugaggaauauuccaucaauccagagucggggacucuuuggcgcaaucgcuggcuucauugaagggggauggacggguauggucgauggcugguacggguaucaccaccagaacgagcaaggaagcggcuacgccgcggaccagaaguccacucagaaugccauaaacgguaucacaaauaaagugaacucuguuauugaaaagaugaauacccaguuuacugcaguggggaaggaguucaacaaacuugagcgccgaauggaaaaccugaauaagaaagucgaugacggcuucaucgauauauggacauacaacgcugaguugcuagugcugcucgaaaaugagagaacccuggacuuucaugacagcaacguaaagaaucuuuaugaaaaaguuaagucacaacugaagaacaaugccaaagagauuggaaacggcugcuucgaguuuuaccacaaguguaaugaugaaugcauggagagugugaaaaacgggacguaugacuaccccaaguauuccgaagagagcaaauugaauagggagaagaucgauggagucaagcucgaaucuauggguguguaccagauccuggcuauuuauucaaccgucgccaguagcuuagugcugcuaguuucccucggcgcaaucucuuucuggaugugcucgaacgggagccugcagugucggauuugcauauga

SEQ ID NO: 128922 - RNA, 1701 nt, Artificial Sequence; identical to SEQ ID NO: 128897
  derived and/or modified sequence opt3 from hemagglutinin__InfluenzaA__AEJ10400

SEQ ID NO: 128923 - RNA, 1701 nt, Artificial Sequence
  derived and/or modified sequence opt3 from hemagglutinin__InfluenzaA__AEJ10410
augaagaccauccuggugguccuccuuuacacauucgccacugcuaacgcagacacgcugugcauuggcuaucacgccaauaacagcaccgauacaauagacacuguuuuggagaaaaaugugaccguaacacauuccgugaacuuacuggaagauaagcacaaugggaaacuauguaagcucagaggagucgcgccccugcaucuugguaaaugcaacaucgcuggcuggauucuggggaauccugagugugaaucuuugucaaccgccaguagcugguccuacaucguggagacuucuucgucagacaacggaacaugcuauccaggcaauuuuauugauuacgaggagcucagggagcagcugagcaguguuuccucuuucgaacgguuugagaucuucccgaagaccagcuccuggucagaccacgauaguaacaagggugugacggcagccuguccccaugcuggggcaaaaaguuuuuauaagaaucugauauggcucgucaaaaagggaaacucuuacccuaaauuauccaagucauauaucaaugacaagggcaaagaagugcugguacuuuggggcauucaccacccaagcacuagcgccgaucaacagucuuuguaccagaacgcugacgccuacguuuucguggggaccucccgcuauagcaagaaauuuaagcccgagaucgcgauucgaccuaaaguccgugaucaggagggaagaaugaauuacuauuggacacugguggaaccaggugacaagaucacuuucgaggcaaccggcaaccuaguggcccccagguacgcuuuugccauggaacggaacgcagggucgggaauaauuaucucugauacaccuguccaugacugcaauaccacgugucaaacuccaaaaggcgcuauuaacacaucccucccguuccagaauauccaccccaucaccauugguaagugcccuaaguauguuaaaucaacuaagcugcgccuugccacagggcugagaaacgugccaaguauacagagcaggggauuguuuggcgcgaucgccggcuucauugaagggggauggaccgguaugguagacggcugguacggguaucaucaccagaaugaacaaggauccggcuacgcagcugaucucaaaucuacgcagaacgccaucgacaagauaaccaauaaagugaacagcgucauugagaagaugaauacacaguuuacugcuguggguaaggaguucaaccaccuggaaaaacggaucgagaauuuaaacaagaaaguugaugacggguuccuggauaucuggaccuacaaugccgaacuccuugugcuguuggagaacgaacgcacacuagacuaucaugauucaaaugucaagaaccuguacgagaaagugcgaagucagcucaagaacaaugcaaaggagauuggcaacggauguuuugaguucuaucacaaaugcgacaauacuuguauggaauccguaaagaacggcaccuacgauuaucccaaauacagcgaagaggccaagcugaauagagaagagaucgacgggguuaaacuugagucuacaaggauuuaucaaauacuggcuaucuacucaaccguggcgaguagcuugguccucguggucucccugggagcaauuucuuuuuggaugugcucgaacgguagcuuacagugccggaucuguaucuga

SEQ ID NO: 128924 - RNA, 1701 nt, Artificial Sequence
  derived and/or modified sequence opt3 from hemagglutinin__InfluenzaA__AEJ10420
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauagacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccgaucacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggaaguacugguucuuuggggcauccaccaccccucaacgagcgcugaccaacagaguuuguaccagaaugccgaugcguacguguucgucgggacuucucgauauuccaaaaaguuuaaaccugagauugcaauccguccaaaggugagagaccaggagggaaggaugaacuacuauuggacccugguggaacccggugauaaaauuacauucgaggccacuggcaaucuagucguuccucgguacgcuuuugccauggaacgcaacgcagggagcggaaucauaauuucggacaccccagugcaugacugcaacacaaccugucaaacgccgaagggcgcuaucaauacuucucuccccuuccagaacauucacccuaucacaaucgguaaaugcccaaaguauguaaaguccaccaaacugagacuugccacugggcugaggaaugugcccucaauucagagucggggauuguuuggcgcgauagccggcuucaucgaagggggauggacagguauggucgauggcugguacggguaucaucaccagaacgaacaaggaagcggcuacgcagcugaccucaaguccacccagaaugccauugauaaaaucacgaacaagguaaauucuguuauagagaaaaugaacacccaguuuacagcuguggguaaggaguucaaucaccuggaaaagcgcauugagaacuuaaauaaaaaggucgacgauggguuccuggacaucuggacuuacaacgccgaacuccuugugcuguuggagaaugaacgaacccuagauuaucaugacagcaacgugaaaaaucuguacgagaagguuagaucacagcucaaaaacaacgcaaaggagaucggcaauggauguuuugaguucuaucacaagugcgauaacacauguauggaaagugugaaaaauggcacuuacgacuauccuaaguacuccgaagaggccaaacugaacagggaagagauugauggggucaaacuugagagcacccggaucuaucaaauucuggcuauauacucuacaguggcgucaaguuugguccucgugguuagccugggagcaaucuccuuuuggaugugcucuaaugguucguuacagugccguauuuguaucuga

SEQ ID NO: 128925 - RNA, 1701 nt, Artificial Sequence
  derived and/or modified sequence opt3 from hemagglutinin__InfluenzaA__AEJ10430
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgagaucaccaauaaggugaacuccguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauucuaauguaaagaaccuguacgagaagguucgaagccagcucaaaaacaaugccaaggaaaucggcaacggauguuuugaguucuaucacaagugcgacaauacuuguauggaaucagugaaaaacggcaccuacgauuauccaaaguacagugaggaagcaaaacugaauagagaggagauugacggggucaaacuugaauccacaaggaucuaucaaauucuggccauauacagcaccguggcuucuucauugguccucgugguuagucugggagcgaucagcuuuuggaugugcuccaacgguucuuuacagugccggauuuguaucuga

SEQ ID NO: 128926 - RNA, 1701 nt, Artificial Sequence
  derived and/or modified sequence opt3 from hemagglutinin__InfluenzaA__AEJ10440
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagauuuuguaccagaacgccgacaccuacguguucgucgggacaagccgcuauaguaagaaauuuaagccugagaucgcgauucgaccaaaagugcgugaucaggagggaagaaugaauuacuauuggacucugguggaacccggugacaagaucaccuucgaggcaacaggcaaccuagucguuccuagguacgccuuugcuauggaacggaacgccgggucuggaauaauuaucuccgauaccccagugcaugacugcaauacgacuugucaaacaccgaaaggcgcaauuaacaccagccuccccuuccagaauauccacccuaucacuauugguaagugcccaaaguauguaaaaucgacaaagcugcgccuugcuaccgggcugagaaacgugcccucuauacaguccaggggauuguuuggcgccaucgcgggcuucauugaagggggauggacggguauggucgacggcugguacggguaucaucaccagaaugaacaaggaucaggcuacgccgcagaucucaaaaguacccagaacgcuaucgacaagauaacaaauaaagugaacagcguuauugagaagaugaauacucaguuuaccgccguggguaaggaguucaaccaccuggaaaaacggaucgagaauuuaaacaagaaagucgaugacggguuccuggauaucuggacauacaaugcugaacuccuugugcuguuggagaacgaacgcacucuagacuaucaugauuccaauguaaagaaccuguacgagaaaguucgaaaccagcucaagaauaacgccaaggagauuggcaauggauguuuugaguucuaucacaaaugcgacaacaccuguauggaaucugugaagaauggcacauacgauuauccuaaauacagcgaagaggcaaagcugaacagagaagagaucgacggggucaaacuugagucaaccaggauuuaucaaauacuggccaucuacaguacuguggcuuccagcuugguccucgugguuucucugggagcgauuucauuuuggaugugcaguaaugguagcuuacagugccggaucuguaucuga

SEQ ID NO: 128927 - RNA, 1701 nt, Artificial Sequence; identical to SEQ ID NO: 128840
  derived and/or modified sequence opt3 from hemagglutinin__InfluenzaA__AEJ10450

SEQ ID NO: 128928 - RNA, 1701 nt, Artificial Sequence
  derived and/or modified sequence opt3 from hemagglutinin__InfluenzaA__AEJ10480
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagucugccgaugcguacguguucgucgggacuuccaaguauagcaaaaaguuuaaaccugagauugcagugcgcccaaaggugcgagaccaagagggacguaugaauuacuauuggacccuggucgaacccggugauaaaaucacauucgaggccacuggcaaccuacucguuccuagauacgcuuuugccauggaaaggaacgcagggucgggaauuaucauaucugacaccccagugcacgauugcaauacaaccugucagacgccgaagggcgcuauuaacacuucccugcccuuccagaauauccauccuauuacaaucgguaagugcccaaaauauguaaagucaaccaaacuucggcuggccacuggguugcgcaacgugcccaguauccagagcagaggacucuuuggcgcgauugccggcuucauagaagggggauggacagguauggucgacggcugguacggguaucaccaucaaaaugcacagggauccggcuacgcugccgaccugaagucuacccagaacgcuaucgauaaaauuacgaauaaggugaacagcguuaucgaaaagaugaauacccaguuuacagccguggguaaagaguucaaccacuuagagaagaggauagaaaaucugaacaaaaaggucgacgauggguuccucgacauuuggacuuacaaugcagagcuucugguguugcuagaaaacgagcggacccuggauuaucacgacucaaauguuaaaaaccucuacgaaaagguacgcagucaacugaagaacaaugccaaagagaucggcaacggauguuuugaguucuaucauaagugcgauaauacauguauggaauccgugaaaaacggcacuuacgacuauccuaaguacagcgaggaagcuaaacuuaaucgagaggaaaucgauggggucaagcuggagucuaccagaauuuaucagaucuuggcgauuuacucaacaguggcaaguagccucguccuggugguuuccuuaggagccauaucuuuuuggaugugcucgaacgguagccugcagugcaggaucuguauuuga

SEQ ID NO: 128929 - RNA, 1701 nt, Artificial Sequence
  derived and/or modified sequence opt3 from hemagglutinin__InfluenzaA__AEJ10490
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucggucgcugccccaaguauguaaagucuacuaaacugagacuugcuacagggcugaggaacgugccuuccauucagucacggggauuguuuggcgccauagcgggcuucaucgaagggggauggaccgguauggucgacggcugguacggguaucaucaccagaaugaacaaggaaguggcuacgccgcagaucucaagagcacgcagaacgcuauugacgguaucaccaauaaagugaacuccguuauagagaagaugaauacacaguuuacugccguggggaaagaguucaaccaccuggaaaagcgcauugagaauuuaaacaagaaagucgaugacggcuuccuggauaucuggaccuacaaugcugaacuccuugugcuguuggagaacgaacgaacacuagacuaucaugauucuaauguaaagaaccuguacgagaaaguuagaagccagcucaagaacaaugccaaagagaucggaaacggcuguuuugaguucuaucacaagugcgacaauacuuguauggaaucagugaagaacgggaccuacgauuauccaaaauacagugaagaggcaaagcugaauagggaagagauugacggagucaaacuugaguccacaaugaucuaucaaauucuggccauauacagcaccguggcuucuucauugguccucaucgugagucugggugcgauuagcuuuuggaugugcuccaacggcucuuuacagugccggaucuguaucuga

SEQ ID NO: 128930 - RNA, 1701 nt, Artificial Sequence
  derived and/or modified sequence opt3 from hemagglutinin__InfluenzaA__AEJ10500
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaggcuuuuauaagaaucugaucuggcucgugaaaaagggcaacaguuacccaaaauuaaauaagagcuauauaaacgauaaggggaaagaaguacugguucuuuggggaauccaccaccccucuacgacugcugaccaacaguccuuguaccagaaugccgauaccuacguguucgucgguacaucacgcuauagcaagaaauuuaagccugagauugcgauccgaccaaaagugcgugaccaggagggcagaaugaacuacuauuggacucugguggaacccggggauaagauuaccuucgaggcaacaggaaaccuagucguuccuagguacgccuuugcuauggaacggaaugccggcagugguaucauaauuucugacaccccagugcaugauugcaacacgacuugucaaacaccgaaaggggcaaucaauaccucccuccccuuccagaacauucacccuaucacuaucggaaagugcccaaaguauguaaaaagcacaaagcugcgccuugcuaccggccugagaaaugugcccucgauucagucuaggggcuuguuuggggccauagcgggauucaucgaggguggcuggacggggauggucgacggaugguacggcuaucaucaccagaacgaacaagguuccggguacgccgcagaccucaaaucaacccagaaugcuauugauaagaucacaaacaaagugaauaguguuauagagaagaugaacacucaguuuaccgccgugggcaaggaguucaaucaccuggaaaaacggauugagaacuuaaauaagaaagucgacgauggauuccuggacaucuggacauacaacgcugaacuccuugugcuguuggagaaugaacgcacucuagauuaucaugacagcaacguaaagaaccuguacgagaaaguucgaaaucagcucaagaacaaugccaaggagaucggcaacggguguuuugaguucuaucacaaaugcgauaauaccuguauggaguccgugaagaacggaacauacgacuauccuaaauacucugaagaggcaaagcugaauagagaagagauugauggugucaaacuugagagcaccaggaucuaucaaauucuggccauauacucaacuguggcuaguuccuugguccucgugguuagccugggcgcgaucucuuuuuggaugugcucaaacgggaguuuacagugccggauuuguaucuga

SEQ ID NO: 128931 - RNA, 1701 nt, Artificial Sequence; identical to SEQ ID NO: 128883
  derived and/or modified sequence opt3 from hemagglutinin__InfluenzaA__AEJ10510

SEQ ID NO: 128932 - RNA, 1701 nt, Artificial Sequence
  derived and/or modified sequence opt3 from hemagglutinin__InfluenzaA__AEJ10520
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaauuaugauucaaacaagggugucaccgccgcuuguccucacgcaggggccaaaaguuuuuacaagaaucugaucuggcucgugaaaaagggaaacagcuauccaaaauuaucuaaguccuacauaaaugacaagggcaaagaaguacugguucuuuggggcauccaucaccccucaacgagcgcugaucaacagaguuuguaccagaacgccgacgcguauguguucgucgggacuucucgcuacuccaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcuccaaguacguaaaaucaaccaagcugcgccuugccacugggcugagaaacgugccaaguauucagagcaggggauuguuuggcgcgauagccggcuucaucgaagggggauggacagguauggucgacggcugguauggguaccaccaucagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuauaaugccgagcuccuugugcuguuggaaaacgagcgcacccuagacuaccacgauucaaauguaaagaaccuguaugagaagguucgaagucagcucaaaaacaaugcaaaggaaaucggcaacggauguuuugaguucuaccauaagugcgacaauacauguauggaauccgugaaaaacggcacuuaugauuaccccaaguauagcgaggaagccaaacugaauagagaggagauugacggggucaaacuugaaucuaccaggaucuaccaaauucuggcuauauacucaacaguggcgaguagcuugguccucgugguuucccugggagcaaucucuuuuuggaugugcucgaacgguagcuuacagugccggauuuguaucuga

SEQ ID NO: 128933 - RNA, 1701 nt, Artificial Sequence; identical to SEQ ID NO: 124685
  derived and/or modified sequence opt3 from hemagglutinin__InfluenzaA__AEJ10530

SEQ ID NO: 128934 - RNA, 1701 nt, Artificial Sequence; identical to SEQ ID NO: 124685
  derived and/or modified sequence opt3 from hemagglutinin__InfluenzaA__AEJ10540

SEQ ID NO: 128935 - RNA, 1701 nt, Artificial Sequence; identical to SEQ ID NO: 124685
  derived and/or modified sequence opt3 from hemagglutinin__InfluenzaA__AEJ10550

SEQ ID NO: 128936 - RNA, 1701 nt, Artificial Sequence
  derived and/or modified sequence opt3 from hemagglutinin__InfluenzaA__AEJ10570
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacgacgggaaacucuguaagcugagaggaguggcuccccuucaucuggguaaaugcaauauagccggcuggaucuuggggaacccugagugugaaucucucucaacagcaaguagcugguccuacauuguugagaccucuucgucagauaauggaacuugcuauccaggcgacuucaucgauuacgaggagcugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucuaaguccuauauaaacgauaagggcaaagaaguacuuguuuuguggggcauccaccaccccucaacgagcgcugaccaacagagucuguaccagaaugccgaugcguacguguuugucgggacuucucgcuauuccaagaaauucaagccugagauugcaauccgaccaaaagugcgugaccaggagggaagaaugaacuacuauuggacccuaguggaacccggugauaagauuacauuugaggccacuggcaaucucgucguuccuagguacgcuuucgccauggaacggaacgcagggagcggaaucauaauuucggacaccccagugcaugacugcaacgcuacaugucaaaccccgaaaggcgccaucaauacgucucugcccuuucagaacauucacccuaucacuaucgguaagugcccaaaguauguaaaauccacaaaacuucgccuggcgaccggguugagaaaugugcccucaauucagaguaggggacucuucggcgccauagcaggcuuuaucgaagggggauggacugguauggucgauggcugguacggguaucaucaccagaacgaacaaggaagcggcuacgcugccgaccugaaguccacacagaaugcuauugauaagaucaccaacaaaguuaauucugugauagagaagaugaacacgcaguucaccgccguggguaaggaguuuaaucacuuagaaaaacggauugagaaccugaauaagaaagucgacgauggguuccucgacaucuggacauacaacgcagaacuucugguguugcuagagaaugaacgcacucuggauuaucaugacagcaacguaaagaaucucuacgagaaaguucgaucacagcugaagaacaacgccaaggagaucggcaauggauguuucgaauuuuaucacaaaugcgauaacaccuguauggagagugugaagaauggcacauacgacuauccuaaauacuccgaagaggcuaaacuuaacagagaagagauugauggggucaagcuggagagcacuaggaucuaucaaauuuuggcgauauacucuaccguggcaucaagucucguccuggugguuagcuuaggagccaucuccuucuggaugugcucuaaugguucgcugcagugccggauuuguaucuga

SEQ ID NO: 128937 - RNA, 1701 nt, Artificial Sequence; identical to SEQ ID NO: 128936
  derived and/or modified sequence opt3 from hemagglutinin__InfluenzaA__AEJ10580

SEQ ID NO: 128938 - RNA, 1701 nt, Artificial Sequence
  derived and/or modified sequence opt3 from hemagglutinin__InfluenzaA__AEJ36302
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucauauaacggaacuugcuacccaggcgacuuuaucgauuaugaggagcucagggagcagcugagcaguguguccucuuucgaacgguuugagauuuucccgaagacaagcuccuggcccaaucacgacccuaacaagggugucaccgccgcuuguccacaugcaggggccaaaucauuuuacaagaaucugaucuggcucgugaaaaagggaaacaguuaucccaaauuaagcaagucuuacauaaaugauaagggcaaagaaguacugguucuuuggggcauccaccacccuuccacgucagcugaccaacagcgcuuguaccagaacgccgaugcguaugcauucguggggacuagccgauacaguaagaaauuuaagccagagauugccauccgucccaaagucagagaccaggagggaaggaugaauuauuacuggacccugguggaaccuggugauaagauuacauucgaggcuacuggcaaccuaguggucccacgguaugccuuugcaauggaacgcaacgcugggucuggaaucauaauuuccgacaccccggcccaugauugcaauacaaccugucaaacgcccaaaggcgcgaucaacacuagccucccuuuccagaauguucacccaauuacaaucgguaagugccccaaguacgugaaaucgaccaagcugagacuugccacugggcugaggaacguaccuucuauccagucccggggauuguuuggcgcaauugcuggcuucauagaagggggauggacagguaugguggacggcugguauggguaccaucaccagaaugaacaaggaucaggcuacgccgcugaccucaaaaguacccagaacgccuuugaugagaucacgaauaaggucaacagcgugauugagaaaaugaauacccaguucacagcaguugguaaggaguucaaccaccuggaaaagcgcaucgaaaauuuaaacaaaaagguggacgauggguuucuggacauauggacuuauaaugccgagcuccuuguccuguuggaaaacgagcgaacccuagauuaccaugacuccaaugugaaaaaccuguaugagaagguaagaucucagcucaaaaacaaugcuaaggaaacaggcaacggauguuucgaguuuuaccacaagugcgauaauacuuguauggaaagcguuaaaaacggcaccuaugacuacccaaaguauucagaggaagcgaaacugaauagggaggagauugauggggugaaacuugaaaguacacggaucuaccaaauccuggcaauuuacuccaccgucgccagcucuuuggugcucgucgugucacugggagcuaucaguuucuggaugugcagcaacgguuccuuacagugccguauuuguauauga

SEQ ID NO: 128939 - RNA, 1701 nt, Artificial Sequence
  derived and/or modified sequence opt3 from hemagglutinin__InfluenzaA__AEJ36312
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacauucaguuuaccgcuguggguaaggaguucaaucaccuggaaaaacggaucgagaacuuaaauaagaaagucgacgauggguuccuggacaucuggacauacaacgccgaacuccuugugcuguuggagaaugaacgcacucuagauuaucaugacagcaacguaaagaaucuguacgagaaaguucgaucacagcucaagaacaacgcaaaggagauuggcaauggauguuuugaguucuaucacaaaugcgauaacaccuguauggaaagugugaagaauggcacauacgacuauccuaaauacuccgaagaggccaagcugaacagagaagagaucgauggggucaaacuugagagcacuaggauuuaucaaauacuggcuaucuacucuaccguggcgucaaguuugguccucgugguuagccugggagcaauuuccuuuuggaugugcucuaaugguucguuacagugccggaucuguaucuga

SEQ ID NO: 128940 - RNA, 1701 nt, Artificial Sequence
  derived and/or modified sequence opt3 from hemagglutinin__InfluenzaA__AEJ37853
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugaggccucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacaagaucaccaauaaagugaacucuguuauagagaagaugaauacgcaguuuaccgccguggguaaggaguucaaccaccuggaaaaacggauugagaauuuaaacaagaaagucgaugacggguuccuggauaucuggacauacaaugcagaacuccuugugcuguuggagaacgaacgcacucuagacuaucaugauagcaauguaaagaaccuguacgagaaaguucgaucacagcucaagaacaaugccaaggagaucggcaacggauguuuugaguucuaucacaaaugcgacaauauguguauggaaagugugaagaacggcaccuacgauuauccuaaauacuccgaagaggcuaagcugaauagagaagagauugacggggucaaacuugagagcacaaggaucuaucaaauucuggcgauauacucuacuguggcaucaaguuugguccucgugguuagccugggagccaucuccuuuuggaugugcucuaacgguucguuacagugccggauuuguaucuga

SEQ ID NO: 128941 - RNA, 1701 nt, Artificial Sequence
  derived and/or modified sequence opt3 from hemagglutinin__InfluenzaA__AEJ37863
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaacugcgugaucaggagggaagaaugaauuacuauuggacccuaguggaacccggugacaagauuacauucgaggccacuggcaaccucguggucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggacggcugguacggguaucaucaccagaaugaacaaggaagcggcuacgcagcugaucugaaguccacccagaacgccauugacaagaucacgaauaaagucaacucugugauagagaagaugaauacccaguuuacagcuguugguaaggaguucaaccacuuagaaaaacggauugagaaucugaacaagaaaguggaugacggguuccucgauaucuggacuuacaaugccgaacuucuggucuugcuagagaacgaacgcacccuggacuaucaugauagcaaugugaagaaccucuacgagaaaguacgaucacagcugaagaacaaugcaaaggagaucggcaacggauguuuugaguucuaucacaaaugcgacaauacauguauggaaaguguuaagaacggcacuuacgauuauccuaaauacuccgaagaggccaaacuuaauagagaagagauugacggggugaagcuggagagcaccaggaucuaucaaauuuuggcuauauacucuacagucgcgucaagucucgugcuggucgugagcuuaggagcaaucuccuuuuggaugugcucuaacgguucgcugcagugccggauuuguaucuga

SEQ ID NO: 128942 - RNA, 1701 nt, Artificial Sequence; identical to SEQ ID NO: 125849
  derived and/or modified sequence opt3 from hemagglutinin__InfluenzaA__AEJ37873

SEQ ID NO: 128943 - RNA, 1701 nt, Artificial Sequence; identical to SEQ ID NO: 128897
  derived and/or modified sequence opt3 from hemagglutinin__InfluenzaA__AEJ37883

SEQ ID NO: 128944 - RNA, 1701 nt, Artificial Sequence
  derived and/or modified sequence opt3 from hemagglutinin__InfluenzaA__AEJ37893
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcaauuuuaucgauuacgaggagcucagggagcagcugagcaguguguccucuuucgaacgguuugagauuuucccgaagaccagcuccuggcccgaccacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucgccccuagguacgcuuuugccauggaacggaacgcagggagcggaaucauaauuucggauaaaccaguucaugacugcaauacaaccugucaaacgccgaagggcgcuaucaacacuucucuccccuuccagaauauucacccuaucacaaucgguaagugcccaaaauaugugaaguccaccaaacugcgccuugccacugggcugagaaacguacccucaauucagaguaggggauuguuuggcgcgauagccggcuucaucgaagggggauggacagguaugguggacggcugguacggguaucaucaccagaaugaacaaggaagcggcuacgcagcugaucucaaguccacccagaacgccauugacaaaaucacgaauaaggucaacucugugauagagaagaugaauacccaguuuacagcuguugguaaagaguucaaccaccuggaaaagcggauugagaauuuaaacaaaaagguggaugacggguuccuggauaucuggacuuacaaugccgaacuccuuguccuguuggagaacgaacgcacccuagacuaucaugauagcaaugugaaaaaccuguacgagaagguacgaucacagcucaagaacaaugcaaaagagaucggcaacggauguuuugaguucuaucacaagugcgacaauacauguauggaaaguguuaaaaacggcacuuacgauuauccuaaguacuccgaagaggccaaacugaauagagaagagauugacggggugaaacuugagagcaccaggaucuaucaaauucuggcuauauacucuacagucgcgucaaguuuggugcucgucgugagccugggagcaaucuccuuuuggaugugcucuaacgguucguuacagugccggauuuguaucuga

SEQ ID NO: 128945 - RNA, 1701 nt, Artificial Sequence; identical to SEQ ID NO: 128897
  derived and/or modified sequence opt3 from hemagglutinin__InfluenzaA__AEJ37903

SEQ ID NO: 128946 - RNA, 1701 nt, Artificial Sequence
  derived and/or modified sequence opt3 from hemagglutinin__InfluenzaA__AEJ37923
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaaucgaacggauggcugggagcggaauaauuaucucggauaccccaguucaugacugcaacacaaccugucaaacgccgaaaggcgccauuaauacuucucuccccuuccagaacauccacccuaucacaauugguaagugcccaaaguaugugaaauccaccaagcugcgccuugcgacugggcugagaaauguacccucaauacagaguaggggauuguuuggcgccaucgcaggcuucauugaagggggauggacagguaugguggacggcugguacggguaucaucaccagaacgaacaaggaagcggcuacgcugccgaucucaaauccacccagaaugcuaucgacaagauaacgaacaaagucaauucugugauugagaagaugaacacccaguuuacagccguugguaaggaguucaaucaccuggaaaaacggaucgagaacuuaaauaagaaaguggaugacggguuccuggauaucuggacuuacaacgcagaacuccuuguccuguuggagaaugaacgcacccuagacuaucaugauagcaacgugaagaaucuguacgagaaaguacgaucacagcucaagaacaacgccaaggagauuggcaauggauguuuugaguucuaucacaaaugcgacaacacauguauggaaaguguuaagaauggcacuuacgauuauccuaaauacuccgaagaggcuaagcugaacagagaagagaucgacggggugaaacuugagagcaccaggauuuaucaaauacuggcgaucuacucuacagucgcaucaaguuuggugcucgucgugagccugggagccauuuccuuuuggaugugcucuaaugguucguuacagugccggaucuguaucuga

SEQ ID NO: 128947 - RNA, 1701 nt, Artificial Sequence
  derived and/or modified sequence opt3 from hemagglutinin__InfluenzaA__AEJ37943
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaccagaaugaacaaggaagcggcuaugcagcugaucucaaauccacccagaacgccauugacaagaucacgaauaaagugaacucuguuauagagaagaugaauacccaguuuacagcuguggguaaggaguucaaccaucuggaaaaacggauugagaauuuaaacaagaaagucgaugacggguuccuggauaucuggacuuacaaugccgaacuccuugugcuguuggagaacgaacgcacccuagacuaccacgauagcaauguaaagaaccuguaugagaaaguucgaucacagcucaagaacaaugcaaaggagaucggcaacggauguuuugaguucuaccauaaaugcgacaauacauguauggaaagugugaagaacggcacuuaugauuacccuaaauauuccgaagaggccaagcugaauagagaagagauugacggggucaaacuugagagcaccaggaucuaccaaauucuggcuauauauucuacaguggcgucaaguuugguccucgugguuagccugggagcaaucuccuuuuggaugugcucuaacgguucguuacagugccggauuuguaucuga

SEQ ID NO: 128948 - RNA, 1701 nt, Artificial Sequence; identical to SEQ ID NO: 128897
  derived and/or modified sequence opt3 from hemagglutinin__InfluenzaA__AEJ37953

SEQ ID NO: 128949 - RNA, 1701 nt, Artificial Sequence
  derived and/or modified sequence opt3 from hemagglutinin__InfluenzaA__AEJ37963
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccacuaacacaucucuccccuuccagaauauccacccuauuaccaucgguaagugcccaaaguaugugaaauccacuaagcugcgccuugcgacagggcugagaaacguacccucaauccagaguaggggauuguuuggcgccauugcaggcuucauagaagggggauggaccgguaugguggacggcugguacggguaucaucaccagaaugaacaaggaagcggcuacgcugccgaucucaaauccacgcagaacgcuaucgacaagauuaccaauaaagucaacucugugaucgagaagaugaauacacaguuuacugccguugguaaggaguucaaccaccuggaaaaacggauagagaauuuaaacaagaaaguggaugacggguuccuggauauuuggaccuacaaugcagaacuccuuguccuguuggagaacgaacgcacacuagacuaucaugauagcaaugugaagaaccuguacgagaaaguacgaucacagcucaagaacaaugccaaggagaucggcaacggauguuuugaguucuaucacaaaugcgacaauacuuguauggaaaguguuaagaacggcaccuacgauuauccuaaauacuccgaagaggcuaagcugaauagagaagagaucgacggggugaaacuugagagcacaaggauuuaucaaauccuggcgauuuacucuaccgucgcaucaaguuuggugcucgucgugagccugggagccauauccuuuuggaugugcucuaacgguucguuacagugccggaucuguauuuga

SEQ ID NO: 128950 - RNA, 1701 nt, Artificial Sequence; identical to SEQ ID NO: 125849
  derived and/or modified sequence opt3 from hemagglutinin__InfluenzaA__AEJ37973

SEQ ID NO: 128951 - RNA, 1701 nt, Artificial Sequence; identical to SEQ ID NO: 128897
  derived and/or modified sequence opt3 from hemagglutinin__InfluenzaA__AEJ37983

SEQ ID NO: 128952 - RNA, 1701 nt, Artificial Sequence; identical to SEQ ID NO: 127549
  derived and/or modified sequence opt3 from hemagglutinin__InfluenzaA__AEK21369

SEQ ID NO: 128953 - RNA, 1698 nt, Artificial Sequence; identical to SEQ ID NO: 125632
  derived and/or modified sequence opt3 from hemagglutinin__InfluenzaA__AEK21380

SEQ ID NO: 128954 - RNA, 1701 nt, Artificial Sequence
  derived and/or modified sequence opt3 from hemagglutinin__InfluenzaA__AEK21396
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcaauccgcccaaaggugcgagaccaggagggacguaugaacuacuauuggacccugguggaacccggugauaaaauuacauucgaggccacuggcaaucuacucgucccuagauacgcuuuugaaauggagaggaaaagcgggucgggaaucauaauuucugacaccccaguucaugacugcaacacaaccugucaaacgccgaagggcgccaucaacacuucccugcccuuccagaauauucacccuaucacaaucgguaagugcccaaaguaugugaaaucaaccaaacuucggcuggcaacuggguugcgcaacguacccaguauucagagcagaggacucuuuggcgcuauagccggcuucaucgaagggggauggacagguaugguggauggcugguacggguaucaucaccagaaugagcaaggauccggcuacgcggccgaccugaagucuacccagaacgcaauugaugagaucacgaauaaggucaacagcgugauagaaaagaugaauacccaguuuacagcuguugguaaagaguucaaccacuuagaaaagaggauugagaaucugaacaaaaagguggacgauggguuccucgacaucuggacuuacaaugccgaacuucuggucuugcuagagaacgagcggacccuggauuaucaugacucaaaugugaaaaaccucuacgaaaagguacgcagucagcugaagaauaacgcuaaagagaucggcaacggauguuuugaguucuaucacaagugcgauaauacauguauggaguccguuaaaaacggcacuuacgacuauccuaaguacagcgaagaggccaaacuuaaucgagagaagauugauggggugaagcuggaaucuaccagaaucuaucaaauuuuggcaauauacucaacagucgccaguagccucgugcuggucguguccuuaggagcuaucucuuuuuggaugugcucgaacgguagccugcagugcaggauuuguaucuga

SEQ ID NO: 128955 - RNA, 1701 nt, Artificial Sequence
  derived and/or modified sequence opt3 from hemagglutinin__InfluenzaA__AEK21406
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguauguccucuuucgaacgguuugagauuuucccgaagacaagcuccuggcccgaucacgacucaaauaagggugugaccgccgcuuguccucaugcaggggccaaaaguuuuuauaagaaccugaucuggcucgucaaaaagggaaauagcuacccaaaauuaucuaaguccuauauaaacgauaagggcaaagaagugcugguacuuuggggcauccaccaccccucaacgagcgcugaccaacagaguuuguaccagaaugccgaugcguacguuuucguggggacuucucgcuauuccaagaaauuuaagccugagauugcaauccgaccaaaaguccgugaccaggagggaagaaugaacuacuauuggacccugguggaacccggugauaagauuacauucgaggccacuggcaaucuaguggucccuagguacgcuuuugccauggaacggaacgcagggagcggaaucauaauuucggacaccccaguucaugacugcaacacaaccugucaaacgccgaaaggcgcuaucaauacuucucuccccuuccagaacauucacccuaucacaaucgguaagugcccaaaguaugugaaauccaccaagcugcgccuugccacugggcugagaaauguacccucaauucagaguaggggauuguuuggcgcgauagccggcuucaucgaagggggauggacagguaugguggauggcugguacggguaucaucaccagaacgaacaaggaagcggcuacgcagcugaccucaaauccacccagaaugccauugauaagaucacgaacaaagucaauucugugauagagaagaugaacacccaguuuacagcuguugguaaggaguucaaucaccuggaaaaacggauugagaacuuaaauaagaaaguggacgauggguuccuggacaucuggacuuacaacgccgaacuccuuguccuguuggagaaugaacgcacccuagauuaucaugacagcaacgugaagaaucuguacgagaaaguacgaucacagcucaagaacaacgcaaaggagaucggcaauggauguuuugaguucuaucacaaaugcgauaacacauguauggaaaguguuaagaauggcacuuacgacuauccuaaauacuccgaagaggccaagcugaacagagaagagauugauggggugaaacuugagagcaccaggaucuaucaaauucuggcuauauacucuacagucgcgucaaguuuggugcucgucgugagccugggagcaaucuccuuuuggaugugcucuaaugguucguuacagugccggauuuguaucuga

SEQ ID NO: 128956 - RNA, 1701 nt, Artificial Sequence
  derived and/or modified sequence opt3 from hemagglutinin__InfluenzaA__AEK21416
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgaugcguacgucuucguggggaccagucgcuauucuaagaaauuuaagccugagauugcagugcgaccaaaaguccgugaccaggagggaagaaugaauuacuauuggacacugguugaacccggugauaagaucacuuucgaggccaccggcaaccuagugguaccuagguacgcuuuugccauggaacggaacgcaggguccggaauuaucauaagcgacacaccagugcaugauugcaauaccacgugucaaacuccgaaaggcgcuauuaacacaucgcuccccuuccagaauauccacccuauuaccaucgguaagugcccaaaguaugucaaaucuacuaagcugcgccuugccacagggcugagaaacgugcccuccauccagucaaggggauuguuuggcgcgauugccggcuucauagaagggggauggaccgguaugguugacggcugguacggguaucaucaccagaaugaacaaggaaguggcuacgcagcugaccucaaaagcacgcagaacgccaucgauaagauuaccaauaaagugaacuccgucaucgagaagaugaauacacaguuuacugcuguggguaaggaguucaaccaccuggaaaaacggauagagaauuuaaacaagaaaguagacgauggguuccuggacauuuggaccuacaaugccgaacuccuuguucuguuggagaacgaacgcacacuagauuaucaugacucuaaugugaagaaccuguacgagaaaguccgaaaccagcucaagaauaacgcaaaggagaucggcaauggauguuuugaguucuaucacaaaugcgauaacacuuguauggaaagcgugaagaauggcaccuacgacuauccuaaauacucagaagaggccaagcugaacagagaagagaucgauggggucaaacuugagaguacaaggauuuaucaaauccuggcuauuuacuccaccguggcgagcucuuugguucucgugguaucacugggagcaauaaguuuuuggaugugcagcaaugguuccuuacagugccggaucuguauuuga

SEQ ID NO: 128957 - RNA, 1701 nt, Artificial Sequence
  derived and/or modified sequence opt3 from hemagglutinin__InfluenzaA__AEK21426
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugcgcuccaccaaacugagacuugcgacugggcugaggaacguacccucaauucagagucggggauuguuuggcgccauagcaggcuucaucgaagggggauggacagguaugguggacggcugguacggguaucaucaccagaaugaacaaggaagcggcuacgcugccgaucucaaguccacccagaacgcuauugacaaaaucacgaauaaggucaacucugugauagagaaaaugaauacccaguuuacagccguugguaaggaguucaaccaccuggaaaagcgcauugagaauuuaaacaaaaagguggaugacggguuccuggauaucuggacuuacaaugcagaacuccuuguccuguuggagaacgaacgaacccuagacuaucaugauagcaaugugaaaaaccuguacgagaagguaagaucacagcucaaaaacaaugccaaggagaucggcaacggauguuuugaguucuaucacaagugcgacaauacauguauggaaaguguuaaaaacggcacuuacgauuauccuaaguacuccgaagaggcuaaacugaauagggaagagauugacggggugaaacuugagagcacccggaucuaucaaauucuggcgauauacucuacagucgcaucaaguuuggugcucgucgugagccugggagccaucuccuuuuggaugugcucuaacgguucguuacagugccguauuuguaucuga

SEQ ID NO: 128958 - RNA, 1701 nt, Artificial Sequence; identical to SEQ ID NO: 125849
  derived and/or modified sequence opt3 from hemagglutinin__InfluenzaA__AEK21436

SEQ ID NO: 128959 - RNA, 1701 nt, Artificial Sequence
  derived and/or modified sequence opt3 from hemagglutinin__InfluenzaA__AEK21456
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaaacgugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 128960 - RNA, 1701 nt, Artificial Sequence; identical to SEQ ID NO: 128897
  derived and/or modified sequence opt3 from hemagglutinin__InfluenzaA__AEK21466

SEQ ID NO: 128961 - RNA, 1701 nt, Artificial Sequence; identical to SEQ ID NO: 128897
  derived and/or modified sequence opt3 from hemagglutinin__InfluenzaA__AEK21476

SEQ ID NO: 128962 - RNA, 1701 nt, Artificial Sequence; identical to SEQ ID NO: 125849
  derived and/or modified sequence opt3 from hemagglutinin__InfluenzaA__AEK21486

SEQ ID NO: 128963 - RNA, 1701 nt, Artificial Sequence
  derived and/or modified sequence opt3 from hemagglutinin__InfluenzaA__AEK28774
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaaaugacaagcccuuucagaacgugaaucgaaucacauauggugccuguccuagauacgucaaacaaaacacccugaaacuugcuacugggaugaggaaugugccagaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaauugaauagacucaucgguaagacgaacgagaaguuccaccagauugaaaaagaguuuuccgaagucgaggggaggauccaagaccuggaaaaguacguugaggauaccaaaaucgacuuauggucuuauaacgcagagcugcucguggcucuugaaaaucagcauacaauucaccugacugauagcgagaugaacaaguuguucgaaaagaccaagaagcagcuacgggagaaugccgaagacaugggcaacggaugcuuuaaaauauaccauaagugugauaaugcuugcaucggcucaauucgaaacgggacauaugaccacgauguauaccgcgacgaggcccugaauaacagauuccagaucaaaggaguggagcucaagagugguuacaaagacuggauucuguggaucuccuuugcaauaagcugcuuccuucugugugucgccuugcucggcuuuaucaugugggcuugccaaaaggggaauauuagguguaacaucugcauuuga

SEQ ID NO: 128964 - RNA, 1701 nt, Artificial Sequence
  derived and/or modified sequence opt3 from hemagglutinin__InfluenzaA__AEK28785
augaagaccaucauugcccugagcuacauacucugccuuguguucgcucagaaccugcccggcaaugacaacuccgcagccacauuguguuuagggcaccaugcggucccuaauggaacuaucguuaaaacgauuaccaacgaucaaguggagguaacaaaugcuacugaacuggugcagaacucuucaaccggugagaucugcgacaguccacaccagauucuagauggcgaaaauuguacacucaucgacgcccugcuuggggauccgcagugcgacggauuucaaaacaagaaaugggaucuguucgucgagagaagcaaggcauauuccaauuguuaccccuaugacgugccugauuacgccucuuugaggucgcucguugcuucaagcggcacccuggaauuuaacaaugagaguuucaacuggacuggugugacacagaaugggaccuccucugcaugcauacggcgcagcaacaauuccuuuuucucacgacugaacuggcucacgcauuuaaacuuuaaauauccagcccugaaugucacuaugcccaacaaugagcaguucgacaaacuuuacaucuggggagugcaccauccuggcaccgauaaggaccagaucuuuuuguaugcucaagccaguggccguauuacaguaagcacuaaaagaucucagcaggcgguuauuccaaacaucggguccaggccccgggugcgcaauauaccuucaagaauuagcaucuacuggaccauugucaagccaggagauauccugcuaaucaacaguacagguaaucucauugcaccgaggggcuacuucaaaauacggucugggaaguccagcaucaugcgcucggacgcccccauuggaaaauguaacucugaaugcaucaccccuaauggcuccauaccaaacgacaagcccuuucagaaugugaaccgaauuacguauggugcuuguccuagauacgugaagcaaaauacucugaaacuugccacagggaugaggaacgucccagagaagcagacccggggaaucuucggcgcaaucgcuggcuuuauugaaaaugggugggagggaaugguugaugguugguauggcuuccgucaccagaacucagaggggcgcggacaagccgcggaccugaaaaguacucaggccgcaaucgaucagauuaacggcaaguugaauagacucauagguaaaacaaacgaaaaguuccaccagaucgagaaagaauuuagcgagguggaagggaggauucaagaccuggagaaguacguagaggauaccaagaucgacuuaugguccuauaaugcugaacugcucguggcccuugagaaccagcauacgauccaccugaccgauucugaaaugaauaaauuguucgagaagacaaagaagcagcuacgggaaaacgcugaggacaugggcaauggaugcuuuaaaauuuaccauaagugugauaacgccugcauaggcagcauccgaaaugggacuuaugaccacgaugucuaccgcgacgaggcacugaacaauagauuccagauuaagggaguggaacucaaaucagguuacaaggacuggauccuguggauuaguuuugccaucuccugcuuccuucuguguguugcuuugcucggcuuuauaaugugggcgugccaaaaagggaacaucagguguaauauuugcaucuga

SEQ ID NO: 128965 - RNA, 1701 nt, Artificial Sequence
  derived and/or modified sequence opt3 from hemagglutinin__InfluenzaA__AEK28796
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauaaaaucgaggugacuaacgcgaccgaacugguacaaucuucaaguacaggugagauuugcgacagcccacaccagauccuagauggcaagaauuguacccucauagacgcucugcuuggggauccgcagugcgacggauuucagaacaaaaagugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaagacgggacgucuagcgcuugcauccggggauccaaaaauucauuuuucagucgccugaacuggcucacucauuuaaauuuuaaguauccagcacugaacgugaccaugcccaauaacgagcaguucgauaaacuuuacauuuggggcguccaccauccuggcacagacaaggaucagaucuuuuuguaugcccaggcuagcgggcgaauuacugugucuaccaaacguucccaacaggccgcgaucccaaacauaggaucaagacccaggguacggaauauuccuagccgcaucaguauuuacuggacaaucguuaagccaggugacauccugcuaauuaacucuaccggcaaucucauagcaccgagaggguacuucaagaucagguccggaaaaagcucgauuaugcggucugacgcccccaucggcaaguguaacuccgagugcauaacgccuaaugguucaauuccaaacgauaaacccuuucagaaugugaaccgcaucacuuauggggcuuguccucgauacgucaagcagaauacacugaaacuugccaccggaaugagaaacgugccagaaaagcaaacuaggggcaucuucggcgcaauugcuggguuuaucgagaauggaugggaagguaugguggacggcugguauggguuccggcaccagaacagugagggacguggccaggccgcggaucugaaaagcacacaagccgcaauugaccagauaaaugguaaguugaaccgccucaucgggaagaccaaugagaaauuccaccagauugaaaaggaguuuuccgaagucgagggcagaauccaggaucuggaaaaauacguugaggacacgaagaucgauuuauggucuuauaacgcugagcugcucguggcccuugaaaaccaacauaccauucaccugacagacagcgagaugaauaaauuguucgaaaagacuaagaaacagcuaagggagaacgcugaagauaugggaaauggcugcuuuaagauauaccauaaaugugacaacgccugcaucgggucaauucggaauggaaccuaugaucacgacguauaccgagacgaggcacugaacaaucgcuuccagaucaaggguguggagcucaaaaguggcuacaaggauuggauucuguggaucuccuuugccauaagcugcuuccuucugugugucgcuuugcucggguuuaucaugugggcgugccagaagggaaacauuagauguaauaucugcauuuga

SEQ ID NO: 128966 - RNA, 1701 nt, Artificial Sequence
  derived and/or modified sequence opt3 from hemagglutinin__InfluenzaA__AEK28807
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauggcaauuguuaccccuaugacgucccugauuacgcaucuuugaggucgcucguggccucaagcgguacucuggaauuuaacaaugagaguuucaacuggacagggguuacccagaauggaacguccucugcuugcauccgcaagagcaacaauuccuuuuucucacggcugaacuggcucacucauuuaaaguuuaaauauccagcacugaaugugaccaugcccaacaacgagcaguucgacaaacuuuacauuuggggcguccaccauccuggcacagauaaugaccagaucuuuuuguaugcccaagcuagugggcgaauuacugugagcaccaagcguucucagcagacaguaaucccaaacauaggauccagacccaggguucggaauauuccuucacgcaucagcauuuacuggaccaucgugaagccaggugauauccugcuaauuaacaguacgggcaaucucauagccccgagaggguacuucaaaaucaggucuggaaaguccagcauuaugcggucggacgcgcccaucggcaaguguaacucugaaugcauaacuccuaaugguuccauuccaaacgacaaacccuuucagaaugucaaccgcaucacauauggggcauguccucgauacgugaagcaaaauacccugaaacuugccacuggaaugagaaacgugccagagaagcagacaaggggcaucuucggcgcuauugccggguuuaucgaaaauggaugggaggguauggucgauggcugguauggguuccggcaccagaacucagagggacguggccaagcagcugaccugaaaaguacccaggccgcgauugaucagauaaaugguaaguugaaccgccucaucgggaaaacgaacgaaaaguuccaccagauugagaaggaauuuagcgagguugaaggcagaauccaagaccuggagaaauacguggaggauaccaagaucgacuuaugguccuauaaugccgaacugcucguagcacuugagaaccagcauacaauucaccugacugauucugaaaugaauaaauuguucgagaagaccaaaaagcagcuaagggaaaacgcugaggacaugggaaauggcugcuuuaagauauaccauaaaugugauaacgccugcaucgggagcauucggaauggaacauaugaccacgauguguaccgagacgaggcucugaacaaucgcuuccagaucaagggugucgaacucaaaucaggcuacaaggacuggauucuguggaucaguuuugccauauccugcuuccuucuguguguggcauugcucggguuuaucaugugggccugccaaaaaggaaacauuagauguaauaucugcauuuga

SEQ ID NO: 128967 - RNA, 1701 nt, Artificial Sequence
  derived and/or modified sequence opt3 from hemagglutinin__InfluenzaA__AEK28818
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauaacacggguaaucucauagccccgaggggcuacuucaagauccggucugggaaguccagcauuaugcgcucggacgcgcccaucggaaaauguaacucugagugcauaacuccuaauggcuccauuccaaacgacaagcccuuucagaaugucaaccgaaucacauauggugcauguccuagauacgugaaacaaaauacccugaaacuugccacugggaugaggaacgugccagaaaagcagacacggggaaucuucggcgcuauugccggcuuuaucgagaaugggugggaaggaauggucgaugguugguauggcuuccgucaccagaacucagaggggcgcggacaagcagcugaccugaagaguacccaggccgcgauugaucagauaaauggcaaauugaacagacucaucgguaagacgaacgagaaguuccaccagauugaaaaagaguuuagcgaaguugaggggaggauccaagaccuggaaaaguacguggaggauaccaaaaucgacuuaugguccuauaaugccgagcugcucguagcacuugaaaaccagcauacaauucaccugacugauucugagaugaauaaguuguucgaaaagaccaagaagcagcuacgggagaacgcugaagacaugggcaauggaugcuuuaaaauauaccauaagugugauaacgccugcaucggcagcauucgaaaugggacauaugaccacgauguguaccgcgacgaggcucugaacaauagauuccagaucaaaggagucgagcucaagucagguuacaaagacuggauucuguggaucaguuuugccauauccugcuuccuucuguguguggcauugcucggcuuuaucaugugggccugccaaaaggggaacauuagguguaauaucugcauuuga

SEQ ID NO: 128968 - RNA, 1701 nt, Artificial Sequence
  derived and/or modified sequence opt3 from hemagglutinin__InfluenzaA__AEK28828
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcgauauuccuagcagaaucaguauuuacuggaccaucgugaaaccaggagacauccugcuaauuaacucuacggguaaucucauagccccgaggggcuacuucaagauccgguccggaaagagcucgauuaugcgcucugacgcgcccaucgggaaauguaacuccgagugcauaacuccuaauggcucaauuccaaacgauaagcccuuucagaaugucaaccgaaucacauauggugcauguccuagauacgugaaacaaaauacccugaaacuugccacugggaugaggaacgugccagaaaaacagacacggggaaucuucggcgcuauugccggcuuuaucgagaaugggugggaaggaauggucgacgguugguauggcuuccgucaccagaacagugaggggcgcggacaagcagcugaucuuaagagcacccaggccgcgauugaccagauaaauggcaaauugaacagacucaucgguaagacgaaugagaaguuccaccagauugaaaaagaguuuuccgaaguugaggggaggauccaagaucuggaaaaguacguggaggacaccaaaaucgauuuauggucuuauaacgccgagcugcucguagcacuugaaaaccagcauacaauucaccugacugacagcgagaugaauaaguuguucgaaaagaccaagaagcagcuacgggagaacgcugaagauaugggcaauggaugcuuuaaaauauaccauaagugugacaacgccugcaucggcucaauucgaaaugggacauaugaucacgacguguaccgcgacgaggcucugaacaauagauuccagaucaaaggagucgagcucaagagugguuacaaagauuggauucuguggaucuccuuugccauaagcugcuuccuucuguguguggcauugcucggcuuuaucauguggguuugccaaaaggggaacauuagguguaauaucugcauuuga

SEQ ID NO: 128969 - RNA, 1701 nt, Artificial Sequence; identical to SEQ ID NO: 124450
  derived and/or modified sequence opt3 from hemagglutinin__InfluenzaA__AEK28839

SEQ ID NO: 128970 - RNA, 1701 nt, Artificial Sequence
  derived and/or modified sequence opt3 from hemagglutinin__InfluenzaA__AEK28850
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggcugcggguucgcaauauucccagcagaaucaguauuuacuggaccaucgugaaaccuggagauauccuacucauuaacucuacggguaaucugauagccccaaggggcuacuucaagauccgguccgggaaaagcucgauuaugcgcucugacgcgccgaucggaaaguguaacuccgaaugcauaacucccaauggcucaauuccuaacgacaagccauuucagaaugucaaccgaaucacauauggugcaugucccagauacgugaaacaaaauacccuuaagcuggccacugggaugaggaacgugccugagaaacagacacggggaaucuucggcgcuauugccggcuuuaucgaaaaugggugggagggaauggucgaugguugguauggcuuccgucaccagaacagugaggggcgcggacaagcagcugaccucaagagcacccaggccgcgauugaucagauaaauggcaaauugaacagacugaucgguaagacgaacgaaaaauuccaccagauugagaaggaauuuuccgagguugaagggaggauccaagacuuagagaaguacguggaggauaccaaaaucgaccuguggucuuauaaugccgaacuccuuguagcacuggagaaccagcauacaauugauuugacugacagcgaaaugaauaagcuauucgagaaaaccaagaaacagcugcgggaaaacgcugaggauaugggcaauggaugcuuuaagauauaccacaagugugacaacgccugcaucggcucaauucgaaaugggacauaugaucaugacguguaccgcgacgaggcucucaacaauagauuccagaucaaaggagucgaacugaagagugguuacaaagauuggauucuuuggaucuccuuugccauaagcugcuuccuguuguguguggcacuccugggcuuuaucaugugggccugccaaaaggggaacauuagguguaauaucugcauuuga

SEQ ID NO: 128971 - RNA, 1701 nt, Artificial Sequence
  derived and/or modified sequence opt3 from hemagglutinin__InfluenzaA__AEK28861
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuaaaggaaaacgcugaggauaugggcaauggaugcuuuaagauauaccacaaaugugacaacgccugcaucggcucaauucggaaugggacauaugaucaugacguguaccgagacgaggcucugaacaaucgcuuccacaucaagggagucgaacucaaaagugguuacaaggauuggauucuguggaucuccuuugccacuagcugcuuccuucuguguguggcauugcucggcuuuauaaugugggccugccagaaagggaacaucagauguaauauuugcaucuga

SEQ ID NO: 128972 - RNA, 1701 nt, Artificial Sequence
  derived and/or modified sequence opt3 from hemagglutinin__InfluenzaA__AEK28872
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcgauauuccuagcagaaucaguauuuacuggaccaucgugaaaccaggagacauccugcuaauuaauucuacggguaaccucauagccccgaggggcuacuucaagauccgguccgggaaaagcucgauuaugcgcucugacgcgcccaucggaaaguguaauuccgaaugcauaacuccuaacggcucaauuccaaaugauaagcccuuucagaacgucaaucgaaucacauauggugcauguccuagauacgugaaacaaaacacccugaagcuggccacugggaugaggaaugugccagagaaacagacacggggaaucuucggcgcuauugccggcuuuaucgaaaacgggugggagggaauggucgacgguugguauggcuuccgucaccagaauagugaggggcgcggacaagcagcugaucuuaagagcacccaggccgcgauugaccagauaaacggcaaauugaauagacucaucgguaagacgaacgaaaaauuccaccagauugagaaggaauuuuccgagguugaagggaggauccaagaucuggagaaguacguggaggacaccaaaaucgauuuauggucuuauaacgccgaacugcucguagcacuugagaaucagcauacaauucaccugacugacagcgaaaugaacaaguuguucgagaaaaccaagaaacagcuacgggaaaaugcugaggauaugggcaacggaugcuuuaagauauaccauaagugugacaaugccugcaucggcucaauucgaaacgggacauaugaucacgacguguaccgcgacgaggcucugaauaacagauuccagaucaaaggagucgaacucaagagugguuacaaagauuggauucuguggaucuccuuugccauaagcugcuuccuucuguguguggcauugcucggcuuuaucaugugggccugccaaaaggggaauauuagguguaacaucugcauuuga

SEQ ID NO: 128973 - RNA, 1701 nt, Artificial Sequence
  derived and/or modified sequence opt3 from hemagglutinin__InfluenzaA__AEK28883
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccucaaacagcuuuuucagccgacugaauuggcucacucauuuaaaguuuaaguauccagcacugaacguuaccaugcccaauaacgagcaguucgacaaacuuuacaucuggggagugcaccauccuggcacagauaacgaccagauuuuucuuuaugcccaggcuucuggccguaucacugucuccaccaagagaucacaacagacagugauaccaaauauugggagcaggccccggguacgcaacaucccuaguagaauuucuaucuacuggaccaucguuaaaccaggagauauucugcuaauaaauuccacggguaaccucaucgccccgaggggcuacuucaagauucggagcgggaaaucgucuaucaugcgcuccgacgcgcccauaggaaaguguaauucagaaugcauuacuccuaacggcaguaucccaaaugacaagcccuuucagaacgugaaucgaaucacauauggugcauguccuagauacgucaaacaaaacacccugaaguuggccacugggaugaggaaugugccagagaaacagacacggggaauuuucggcgcuaucgccggcuuuauugaaaacgggugggagggaaugguggaugguugguauggcuuccgucaccagaauagcgaggggcgcggacaagcagcugaccugaaguccacccaggccgcgauagaucagaucaacggcaaauugaauagacucauugguaagacgaacgaaaaauuccaccagaucgagaaggaauuuucugaggucgaagggaggauccaagaccuggagaaguacguugaggauaccaaaauugacuuauggagcuauaacgccgaacugcucguggcacuugagaaucagcauacaauacaccugacugauucagaaaugaacaaguuguucgagaaaaccaagaaacagcuacgggaaaaugcugaggacaugggcaacggaugcuuuaagaucuaccauaagugugauaaugccugcauuggcaguauccgaaacgggacauaugaccacgauguauaccgcgacgaggcucugaauaacagauuccagauuaaaggaguggaacucaaguccgguuacaaagacuggauccuguggauaaguuuugccaucucuugcuuccuucugugugucgcauugcucggcuuuauuaugugggccugccaaaaggggaauaucagguguaacauuugcaucuga

SEQ ID NO: 128974 - RNA, 1701 nt, Artificial Sequence
  derived and/or modified sequence opt3 from hemagglutinin__InfluenzaA__AEK28894
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauucaccugacugauagcgaaaugaauaaguuguucgagaaaaccaagaaacagcuacgggaaaacgcugaggacaugggcaauggaugcuuuaagauauaccauaagugugauaacgccugcaucggcucaauucgaaaugggacauaugaccacgauguguaccgcgacgaggcucugaacaauagauuccagaucaaaggagucgaacucaagagugguuacaaagacuggauucuguggaucuccuuugccauaagcugcuuccuucuguguguggcauugcucggcuuuaucaugugggccugccaaaaggggaacauuagguguaauaucugcauuuga

SEQ ID NO: 128975 - RNA, 1701 nt, Artificial Sequence
  derived and/or modified sequence opt3 from hemagglutinin__InfluenzaA__AEK28905
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuacguuuuaaguauccagcacugaaugugaccaugcccaacaacgagcaguucgacaaacuuuacauuuggggaguccaccauccuggcacagauaaugaccagaucuuuccauaugcccaagcuagcggcagaauuacugugucuaccaagaggucccagcagacaguaauccccaacauagggucacggccucgcguuagaaauauuccaagcaggaucaguauuuacuggaccaucgugaagccgggagauaucuugcugauuaacucuacggguaaucuaauagcgccccggggcuacuucaaaauccgcuccggaaagagcucgauuaugcgaucugacgccccuaucgggaaauguaacuccgaaugcauaacuccaaauggcucaauucccaacgacaagccuuuucagaaugucaacagaaucacauauggugcauguccaagguacgugaagcaaaauacccucaaacuggccacugggaugcggaacgugcccgagaagcagacacguggaaucuucggcgcuauugccggcuuuaucgaaaaugggugggagggaauggucgaugguugguauggcuuccgccaccagaacagugaggggagaggacaagcagcugaccuuaaaagcacccaggccgcgauugaucagauaaauggcaagcugaacagguugaucgguaaaacgaacgaaaaguuccaccagauugagaaagaauuuuccgagguugaagggcggauccaagaccucgagaaguacguggaggauaccaagaucgaccuguggucuuauaaugccgaauuacugguagcacucgagaaccagcauacaauugaucuuacugacagcgaaaugaauaaacuguucgagaagaccaaaaagcaguugcgagaaaacgcugaggauaugggcaauggaugcuuuaaaauauaccacaagugugacaacgccugcaucggcucaauucgcaaugggacauaugaucaugacguguacagagacgaggcucuaaacaauagguuccagaucaagggagucgaacugaaaagugguuacaaggauuggauucucuggaucuccuuugccauaagcugcuuccugcuuuguguggcacuguugggcuuuaucaugugggccugccaaaaagggaacauucgguguaauaucugcauuuga

SEQ ID NO: 128976 - RNA, 1701 nt, Artificial Sequence
  derived and/or modified sequence opt3 from hemagglutinin__InfluenzaA__AEK28916
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggauucgcaauaucccuagcagaauuaguaucuacuggaccaucguuaaaccaggagauauucugcuaauaaacucuacggguaaucucaucgccccgaggggcuacuucaagauucgguccgggaaaagcucggugaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccagaucaaaggagucgaacucaagagugguuacaaagauuggauucuguggaucuccuuugccauaagcugcuuccuucuguguguggcauugcucggcuuuaucaugugggccugccaaaaggggaacauuagguguaauaucugcauuuga

SEQ ID NO: 128977 - RNA, 1701 nt, Artificial Sequence
  derived and/or modified sequence opt3 from hemagglutinin__InfluenzaA__AEK28927
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacaauucauuuuucagucgacugaacuggcucacucauuuaaaguuuaaguauccagcacugaauguuaccaugcccaacaacgagcaguucgacaaacuuuacaucuggggagugcaccauccuggcacagauaaugaccagaucuuuuuguaugcccaagcuagcggccguauuacugucucuaccaagagaucccagcagacagugauaccaaacauugggucaaggccccggguacgcaauaucccuagcagaauuaguaucuacuggaccaucguuaaaccaggagauauucugcuaauaaacucuacggguaaucucaucgccccgaggggcuacuucaagauucgguccgggaaaagcucgaucaugcgcucugacgcgcccauaggaaaguguaacuccgaaugcauuacuccuaauggcucaaucccaaacgacaagcccuuucagaaugugaaccgaaucacauauggugcauguccuagauacgucaaacaaaauacccugaagcuggccacugggaugaggaacgugccagagaaacagacacggggaauuuucggcgcuaucgccggcuuuauugaaaaugggugggagggaaugguggaugguugguauggcuuccgucaccagaacagugaggggcgcggacaagcagcugaccuuaagagcacccaggccgcgauagaucagaucaauggcaaauugaacagacucauugguaagacgaacgaaaaauuccaccagaucgagaaggaauuuuccgaggucgaagggaggauccaagaccuggagaaguacguugaggauaccaaaauugacuuauggucuuauaaugccgaacugcucguggcacuugagaaccagcauacaauacaccugacugauagcgaaaugaauaaguuguucgagaaaaccaagaaacagcuacgggaaaacgcugaggacaugggcaauggaugcuuuaagaucuaccauaagugugauaacgccugcauuggcucaauccgaaaugggacauaugaccacgauguauaccgcgacgaggcucugaacaauagauuccagauuaaaggaguggaacucaagagugguuacaaagacuggauccuguggauauccuuugccaucagcugcuuccuucugugugucgcauugcucggcuuuauuaugugggccugccaaaaggggaacaucagguguaauauuugcaucuga

SEQ ID NO: 128978 - RNA, 1701 nt, Artificial Sequence
  derived and/or modified sequence opt3 from hemagglutinin__InfluenzaA__AEK28949
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugccugaagauauaccacaagugugacaacgccugcaucggcucaauucgaaaugggacauaugaucaugacguguaccgcgacgaggcucucaacaauagauuucagaucaaaggagucgaacugaagagugguuacaaagauuggauucuuuggaucuccuucgccauaagcugcuuucuguuguguguggcacuccugggcuucaucaugugggccugccaaaaggggaacauuagguguaauaucugcauuuga

SEQ ID NO: 128979 - RNA, 1701 nt, Artificial Sequence; identical to SEQ ID NO: 124450
  derived and/or modified sequence opt3 from hemagglutinin__InfluenzaA__AEK28960

SEQ ID NO: 128980 - RNA, 1701 nt, Artificial Sequence; identical to SEQ ID NO: 124450
  derived and/or modified sequence opt3 from hemagglutinin__InfluenzaA__AEK28971

SEQ ID NO: 128981 - RNA, 1701 nt, Artificial Sequence
  derived and/or modified sequence opt3 from hemagglutinin__InfluenzaA__AEK28982
augaagaccaucauugcccugagcuacauacucugccuuguguucgcucagaaacugcccggcaacuauaauuccacagcaacuuuguguuuagggcaccaugccgucccuaacggaacgaucguuaagaccauuacaaaugaccaaaucgaggugacuaacgcgaccgaacugguacagucuucaaguacaggugagauuugcgauagcccacaccagauccuagacggcgaaaauuguacccucauagaugcucugcuuggggacccgcagugcgauggauuucaaaacaaaaagugggaccuguucguggagagauccaaagccuacucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguacccagcacugaaugugaccaugcccaacaacgagcaguucgauaaacuuuauauuuggggaguccaccauccuggcacagacaaugaucagaucuuuuuguacgcccaagcuagcggccguauuacugugucuaccaagagaucccagcagacaguaaucccaaacauagggucaaggccccggguucgcaauauuccuagcagaaucaguauuuacuggaccaucgugaaaccaggagacauccugcuaauuaacucuacggguaaucucauagccccgaggggcuauuucaagauccgguccgggaaaagcucgauuaugcgcucugaugcgcccaucggaaaguguaacuccgaaugcauaacuccuaauggcucaauuccaaacgacaagcccuuucagaaugucaaccgaaucacauacggugcauguccuagauaugugaaacaaaauacccugaagcuggccacugggaugaggaacgugccagagaaacagacacggggaaucuucggcgcuauugccggcuuuaucgaaaaugggugggagggaauggucgacgguugguacggcuuccgucaccagaacagugaggggcgcggacaagcagcugaucuuaagagcacccaggccgcgauugaccagauaaauggcaaauugaacagacucaucgguaagacgaacgaaaaauuccaccagauugagaaggaauuuuccgagguugaagggaggauccaagaucuggagaaguauguggaggacaccaaaaucgauuuauggucuuacaaugccgaacugcucguagcacuugagaaccagcauacaauucaccugacugacagcgaaaugaauaaguuguucgagaaaaccaagaaacagcuacgggaaaacgcugaggauaugggcaauggaugcuuuaagauauaucauaagugugacaacgccugcaucggcucaauucgaaaugggacauacgaucacgacguguaccgcgaugaggcucugaacaauagauuccagaucaaaggagucgaacucaagagugguuauaaagacuggauucuguggaucuccuuugccauaagcugcuuccuucuguguguggcauugcucggcuuuaucaugugggccugccaaaaggggaacauuagguguaauaucugcauuuga

SEQ ID NO: 128982 - RNA, 1701 nt, Artificial Sequence
  derived and/or modified sequence opt3 from hemagglutinin__InfluenzaA__AEK28993
augaagaccaucauugcccugagcuacauacucugccuuguguucgcucagaaacugcccggcaacuauaauuccacagcaacuuuguguuuagggcaccaugccgucccuaacggaacgaucguuaagaccauuacaaaugaccaaaucgaggugacuaacgcgaccgaacugguacagucuucaaguacaggugagauuugcgauagcccacaccagauccuagacggcgaaaauuguacccucauagaugcucugcuuggggacccgcagugcgauggauuucaaaacaaaaagugggaccuguucguggagagauccaaagccuacucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguacccagcacugaaugugaccaugcccaacaacgagcaguucgauaaacuuuauauuuggggaguccaccauccuggcacagacaaugaucagaucuuuuuguacgcccaagcuagcggccguauuacugugucuaccaagagaucccagcagacaguaaucccaaacauagggucaaggccccggguucgcaauauuccuagcagaaucaguauuuacuggaccaucgugaaaccaggagacauccugcuaauuaacucuacggguaaucucauagccccgaggggcuauuucaagauccgguccgggaaaagcucgauuaugcgcucugaugcgcccaucggaaaguguaacuccgaaugcauaacuccuaauggcucaauuccaaacgacaagcccuuucagaaugucaaccgaaucacauacggugcauguccuagauaugugaaacaaaauacccugaagcuggccacugggaugaggaacgugccagagaaacagacacggggaaucuucggcgcuauugccggcuuuaucgaaaaugggugggagggaauggucgacgguugguacggcuuccgucaccagaacagugaggggcgcggacaagcagcugaucuuaagagcacccaggccgcgauugaccagauaaauggcaaauugaacagacucaucgguaagacgaacgaaaaauuccaccagauugagaaggaauuuuccgagguugaagggaggauccaagaucuggagaaguauguggaggacaccaaaaucgauuuauggucuuacaaugccgaacugcucguagcacuugagaaccagcauacaauugaccugacugauagcgaaaugaauaaguuguucgagaaaaccaagaaacagcuacgggaaaacgcugaggacaugggcaauggaugcuuuaagauauaucacaagugugauaacgccugcaucggcucaauucgaaaugggacauacgaccaugauguguaccgcgacgaggcucugaacaauagauuccagaucaaaggagucgaacucaagagugguuauaaagacuggauucuguggaucuccuuugccauaagcugcuuccuucuguguguggcauugcucggcuuuaucaugugggccugccaaaaggggaacauuagguguaauaucugcauuuga

SEQ ID NO: 128983 - RNA, 1701 nt, Artificial Sequence
  derived and/or modified sequence opt3 from hemagglutinin__InfluenzaA__AEK29004
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugugucguugaggucacucguugcaagcaguggcacucuggaauuuaauaacgaguccuucaauuggacaggugugacccagaacgggacgucuagcgccugcauccggcgcuccaauaacucauuuuucagucgacugaauuggcucacucacuuaaacuuuaaguacccagcucugaacgucaccaugcccaauaacgagcaguucgauaagcuguauauuuggggagugcaucacccuggcacagacaaagaucagaucuuuuuguacgcacaagccagcggccguauuacuguaucuaccaagagaucccagcaggcuguuaucccaaauauagggucaaggccccgggugcgcaacauuccuagcagagucaguaucuauuggacaauugugaaaccaggagacauccugcuaaucaauucuaccgguaaccucauugccccgaggggcuacuucaagauacgguccgggaaaagcucgaucaugcgcucugaugcgcccauuggaaaguguaauuccgcaugcaucacgccuaacggcucaauaccaaaugacaagcccuuucagaacgugaaucgaauuacuuacggugccuguccuagauaugucaaacaaaacacacugaaacuugcuaccgggaugaggaauguuccagaaaaacagacucggggaaucuucggcgccaucgcaggcuuuauugagaacgggugggaaggaaugguggacgguugguacggcuuccgucaccagaauagugaggggcgcggacaagcugccgaucuuaagagcacacaggcggccaucgaccagauuaacggcaaauugaacagacucauagguaagaccaaugagaaauuccaucagaucgaaaaggaguuuuccgaaguagaggggaggauucaagaucuggaaaaguauguggaggacacgaaaaucgauuuauggucuuacaacgcagagcugcucgucgcucuugaaaaucagcacaccaucgaccugacagauagcgagaugaacaaguuguucgaaaagacuaagaaacagcuacgggagaaugccgaagacaugggcaacggaugcuuuaagauuuaucauaagugugauaaugcuugcauaggcucaauccgaaacgggaccuacgaccacgauguguaucgcgacgaggcccugaauaacagauuccagauuaaaggaguugagcucaagagugguuacaaagacuggauccuguggauuuccuuugcaaucagcugcuuccuucuguguguggccuugcucggcuuuauaaugugggcuugccaaaaggggaauaucagguguaacauuugcaucuga

SEQ ID NO: 128984 - RNA, 1701 nt, Artificial Sequence
  derived and/or modified sequence opt3 from hemagglutinin__InfluenzaA__AEK29026
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaagauaagaaaugggaccuguucguggaaagauccaaggccuauucuaacuguuaccccuaugaugucccugacuacgcaucguugaggucacucguggccagcaguggcacucuggaguuuaauaacgaauccuucaauuggacagguguuacccagaacgggacgucuagcgcuugcauccggcgcuccaaaaauucauuuuucagucgacugaacuggcucacucauuuaaauuuuaaauauagcgcacugaacgugaccaugccaaauaacgagcaguucgauaaacuuuacauuuggggaguccaccaucccggcacagacaaggaucagaucuuuuuguaugcccaggcuucuggccguauuacuguguccaccaagagaucacaacagacaguaaucccuaacauagggagcaggccacggguucgcaauauucccaguagaaucucuauuuacuggaccaucgugaaaccuggagacauccugcuaauuaacuccacggguaaucucauagccccaaggggcuacuucaagaugcagagcgggaagucgucuaucaugcgguccgacgcgccgauuggaaaauguaacucagagugcaucacucccaauggcaguauaccuaacgauaagccauuucaaaaugucaaccgcauuacauauggugcauguccccgauacgugaaacagaauacccugaaacuugccacugggaugagaaacgugccugaaaagcagacaaggggaaucuucggcgcuaucgccggcuuuauugagaaugggugggaaggaauggucgacgguugguauggcuuccggcaccaaaacagcgaggggcguggacaggcagcugaucugaaguccacccaggccgcgaucgaccagauuaauggcaaauugaaccgccucauagguaagacgaaugagaaguuccaccaaaucgaaaaagaguuuucugaaguugaggggaggauucaggaucuggaaaaguacguggaggacaccaaaaucgauuuauggagcuauaacgccgagcugcucguagcacuugaaaaccagcauacaaucgaccugacugauucagagaugaauaaguuguucgaaaagaccaagaagcagcuaagagagaacgcugaagacaugggcaauggaugcuuuaaaauuuaccacaagugugauaacgccugcauaggcaguauccggaaugggacauaugaccaugacguguaccgagaugaggcucugaacaaucgcuuccaaauuaaaggagucgagcucaaguccgguuacaaagacuggauccuguggauuagcuuugccaucucuugcuuccuucuguguguggcauugcucggcuuuauaaugugggccugccagaaggggaacaucagauguaauauuugcaucuga

SEQ ID NO: 128985 - RNA, 1701 nt, Artificial Sequence
  derived and/or modified sequence opt3 from hemagglutinin__InfluenzaA__AEK29048
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguugcucagaacgggaccucuagcgcaugcauccggcgcuccaauaacucauuuuucagucgacugaauuggcucacgcacuuaaacuuuaaguacccagcccugaacgugacuaugcccaauaacgagcaguucgauaaacuuuauauuuggggaguccaucacccuggcaccgacaaagaucagaucuuuuuguacgcucaagccgcgggccguauuacagugagcacuaagagaucucagcaggcaguaaucccaaauauaggguccaggccccggguucgcaacauuccuucaagagugagcaucuauuggaccauugucaaaccaggagacauccugcuaaucaauaguacagguaaccucauugccccgaggggcuacuucaagauacggucugggaaauccagcaucaugcgcucggaugcucccauuggaaaguguaauucugccugcaucaccccuaacggcuccauaccaaaugacaagcccuuucagaacgugaaucgaauuacguacggugcauguccuagauaugugaaacaaaacacucugaaacuugcuacagggaugaggaaugucccagaaaagcagacccggggaaucuucggcgccaucgcgggcuuuauugagaacgggugggaaggaaugguugacgguugguacggcuuccgucaccaaaauucagaggggcgcggacaggccgcagaucugaagaguacucaggcugccaucgaccagauuaacggcaaauugaacagacucauagguaagacaaaugagaaauuccaucagaucgaaaaggaguuuagcgaaguggaggggaggauucaagaucuggaaaaguauguagaggacaccaaaaucgauuuaugguccuacaacgcugagcugcucguggcccuugaaaaucagcacacgaucgaccugaccgauucugagaugaacaaguuguucgaaaagacaaagaaacagcuacgggagaaugcagaagacaugggcaacggaugcuuuaagauuuaucauaagugugauaaugccugcauaggcagcauccgaaacgggacuuacgaccacgaugucuaucgcgacgaggcucugaauaacagauuccagauuaaaggaguggagcucaagucagguuacaaagacuggauccuguggauuaguuuugcgaucuccugcuuccuucuguguguugcauugcucggcuuuauaaugugggccugccaaaaggggaauaucagguguaacauuugcaucuga

SEQ ID NO: 128986 - RNA, 1701 nt, Artificial Sequence
  derived and/or modified sequence opt3 from hemagglutinin__InfluenzaA__AEK29070
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaagcuguacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaauacacugaaacuugcuaccgggaugaggaacgugccagagaagcagacucggggaaucuucggcgccauugcaggcuuuaucgaaaaugggugggagggaauggucgaugguugguauggcuuccgucaccagaacagugaggggcgcggacaagcugccgaccuuaagagcacacaggcggccauugaucagauaaauggcaaauugaacagacucaucgguaagaccaacgaaaaauuccaccagauugagaaggaauuuuccgagguugaagggaggauccaagaccuggagaaguacguggaggauacgaaaaucgacuuauggucuuauaaugcagaacugcucguagcucuugagaaccagcauaccauucaccugacagauagcgaaaugaauaaguuguucgagaaaacuaagaaacagcuacgggaaaacgccgaggacaugggcaauggaugcuuuaagauauaccauaagugugauaacgcuugcaucggcucaauucgaaaugggaccuaugaccacgauguguaccgcgacgaggcccugaacaauagauuccagaucaaaggagucgaacucaagagugguuacaaagacuggauucuguggaucuccuuugcaauaagcugcuuccuucuguguguggccuugcucggcuuuaucaugugggcuugccaaaaggggaacauuagguguaauaucugcauuuga

SEQ ID NO: 128987 - RNA, 1701 nt, Artificial Sequence
  derived and/or modified sequence opt3 from hemagglutinin__InfluenzaA__AEK29081
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcauccggcgcucaaacaauagcuuuuucagucgacugaacuggcucacucauuuaaauuuuaaguauccagcucugaacgugaccaugcccaacaaugagcaguucgacaaacuuuacauuuggggaguccaccauccuggcacagauaaggaccagaucuuuuuguaugcacaagccucuggccguauuacuguguccaccaagagaucacagcaggcuguaaucccaaacauagggagcaggccccggguucgcaauauuccuaguagaaucucuauuuacuggacaaucgugaaaccaggagauauccugcuaauuaacuccaccgguaaucucauagccccgaggggcuacuucaagauccggagcgggaaaucgucuauuaugcgcuccgacgcgcccaucggaaaguguaacucagaaugcauaacgccuaauggcaguauuccaaacgacaagcccuuucagaaugucaaccgaaucacuuauggugcauguccuagauacgugaaacaaaauacacugaaacuugccaccgggaugaggaacgugccagagaagcagacucggggaaucuucggcgcuauugccggcuuuaucgaaaaugggugggagggaauggucgaugguugguauggcuuccgucaccagaacagcgaggggcgcggacaagcagcugaccugaaguccacacaggccgcgauugaucagauaaauggcaaauugaacagacucaucgguaagaccaacgaaaaauuccaccagauugagaaggaauuuucugagguugaagggaggauccaagaccuggagaaguacguggaggauacgaaaaucgacuuauggagcuauaaugccgaacugcucguagcacuugagaaccagcauaccauucaccugacagauucagaaaugaauaaguuguucgagaaaacuaagaaacagcuacgggaaaacgcugaggacaugggcaauggaugcuuuaagauauaccauaagugugauaacgccugcaucggcaguauucgaaaugggaccuaugaccacgauguguaccgcgacgaggcucugaacaauagauuccagaucaaaggagucgaacucaaguccgguuacaaagacuggauucuguggaucagcuuugccauaucuugcuuccuucuguguguggcauugcucggcuuuaucaugugggccugccaaaaggggaacauuagguguaauaucugcauuuga

SEQ ID NO: 128988 - RNA, 1701 nt, Artificial Sequence; identical to SEQ ID NO: 127549
  derived and/or modified sequence opt3 from hemagglutinin__InfluenzaA__AEK29092

SEQ ID NO: 128989 - RNA, 1701 nt, Artificial Sequence; identical to SEQ ID NO: 128871
  derived and/or modified sequence opt3 from hemagglutinin__InfluenzaA__AEK29125

SEQ ID NO: 128990 - RNA, 1701 nt, Artificial Sequence; identical to SEQ ID NO: 128871
  derived and/or modified sequence opt3 from hemagglutinin__InfluenzaA__AEK29136

SEQ ID NO: 128991 - RNA, 1701 nt, Artificial Sequence; identical to SEQ ID NO: 128871
  derived and/or modified sequence opt3 from hemagglutinin__InfluenzaA__AEK29169

SEQ ID NO: 128992 - RNA, 1701 nt, Artificial Sequence; identical to SEQ ID NO: 128871
  derived and/or modified sequence opt3 from hemagglutinin__InfluenzaA__AEK29180

SEQ ID NO: 128993 - RNA, 1701 nt, Artificial Sequence; identical to SEQ ID NO: 128871
  derived and/or modified sequence opt3 from hemagglutinin__InfluenzaA__AEK29191

SEQ ID NO: 128994 - RNA, 1701 nt, Artificial Sequence; identical to SEQ ID NO: 128871
  derived and/or modified sequence opt3 from hemagglutinin__InfluenzaA__AEK29202

SEQ ID NO: 128995 - RNA, 1701 nt, Artificial Sequence; identical to SEQ ID NO: 128871
  derived and/or modified sequence opt3 from hemagglutinin__InfluenzaA__AEK29213

SEQ ID NO: 128996 - RNA, 1701 nt, Artificial Sequence; identical to SEQ ID NO: 128871
  derived and/or modified sequence opt3 from hemagglutinin__InfluenzaA__AEK29224

SEQ ID NO: 128997 - RNA, 1701 nt, Artificial Sequence; identical to SEQ ID NO: 128871
  derived and/or modified sequence opt3 from hemagglutinin__InfluenzaA__AEK29235

SEQ ID NO: 128998 - RNA, 1701 nt, Artificial Sequence
  derived and/or modified sequence opt3 from hemagglutinin__InfluenzaA__AEK29268
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugguugacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguggaggggaggauucaagaucuggaaaaguauguagaggacacgaaaaucgauuuauggucuuacaacgcugagcugcucguggcccuugaaaaucagcacaccaucgaccugacagauagcgagaugaacaaguuguucgaaaagacuaagaaacagcuacgggagaaugcugaagacaugggcaacggaugcuuuaagauuuaucauaagugugauaaugccugcauaggcucaauccgaaacgggaccuacgaccacgaugucuaucgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 128999 - RNA, 1698 nt, Artificial Sequence
  derived and/or modified sequence opt3 from hemagglutinin__InfluenzaA__AEK59838
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccagacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaaugggaaaucaaguuuuuauaagaacuuacuguggcuuaccggaaagaauggcuuguaccccaaccugagcaagucuuaugcaaauaacaaagaaaaggaggugcuaguucucuggggcgugcaccacccuccaaauaucggggaccagaaggcccuguaccauacggaaaacgcuuacgucuccguggugucaagccacuauaguaaaaaguucacucccgagauagcaaaacggccuaagguccgcgaucaggaaggacgaaucaacuacuauuggacccuucuggagccagguaauacaauuaucuuugaggccaacggcaauuugauugcuccgcguuacgccuucgcgcucucuagaggguuuggauccggcaucauaaacagcaaugcacccauggacaaaugugaugccaagugccagacuccucaaggugcuauuaacucgucucugccauuccagaauguucaucccgugaccaucggggaauguccuaaauauguaagguccgccaaguuacggauggugacaggacugcgcaacauuccaucaauccagaguagaggccucuuuggcgcaaucgcuggguucauugagggagguuggaccggcauggucgacgggugguacggauaucaccaccagaaugaacaaggcagcgguuacgccgcggaucagaaguccacgcagaacgccauaaaugggaucacuaacaaaguaaauucuguuauugagaagaugaacacacaguuuaccgcagugggcaaagaguucaauaaacuugaaaggcggauggagaaccugaacaaaaaggucgacgauggauucaucgacauauggacuuacaaugcugaauugcuagugcugcucgagaacgaacgcacacuggacuuucaugauagcaauguaaagaaccuuuaugagaaaguuaagucacaacugaaaaauaacgccaaggaaauuggcaaugggugcuucgaguuuuaccacaaauguaacgacgagugcauggaaagugugaagaauggaaccuaugauuaccccaaguauuccgaggaaagcaaauugaaccgagagaagaucgacggugucaaacucgagucuaugggcguguaccagauccuggcuauuuauucaacggucgccaguagcuuagugcugcuaguuucccucggggcaaucucuuucuggaugugcucgaauggaagccugcaguguagaauuugcauauga

SEQ ID NO: 129000 - RNA, 1701 nt, Artificial Sequence
  derived and/or modified sequence opt3 from hemagglutinin__InfluenzaA__AEK98378
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuccauaugcccaggcuagcggccguauuacugugucuaccaagagaucccaacagacaguaauccccaacauagggucaaggccucggguucgcaauauuccaagcagaaucaguauuuacuggaccaucgugaagccgggagauaucuugcugauuaacucuacggguaaucuaauagcccccaggggcuacuucaaaauccaguccggaaagagcucgauuaugcggucugacgcgccuaucgggaaguguaacuccgaaugcauaacuccaaauggcucaauucccaacgacaaaccuuuucagaaugucaaccgcaucacauauggugcauguccacgauacgugaagcaaaauacccucaaacuggccacugggaugagaaacgugcccgagaagcagacaaggggaaucuucggcgcuauugccggcuuuaucgaaaaugggugggagggaauggucgaugguugguauggcuuccggcaccagaacagugaggggauuggacaagcagcugaccuuaaaagcacccaggccgcgauagaucagaucaauggcaagcugaaccguuugauugguaaaacgaacgaaaaguuccaccagaucgagaaggaauuuuccgagguugaagggcgcauccaagaccucgagaaauacguggaggauaccaagauugaccuguggucuuauaaugccgaauuacugguagcacucgagaaccagcauacaauagaucuuacugacagcgaaaugaauaaacuguucgagaagaccaaaaagcaguugagagaaaacgcugaggauaugggcaauggaugcuuuaagaucuaccacaaaugugacaacgccugcauuggcucaaucaggaaugggacauaugaucaugacguguaccgggacgaggcucuaaacaaucgauuccagauuaagggagucgaacugaaaagugguuacaaggauuggauccucuggauauccuuugccaucagcugcuuccugcuuuguguggcacuguugggcuuuauuaugugggccugccaaaaagggaacauccgcuguaauauuugcaucuga

SEQ ID NO: 129001 - RNA, 1701 nt, Artificial Sequence; identical to SEQ ID NO: 123931
  derived and/or modified sequence opt3 from hemagglutinin__InfluenzaA__AEK98380

SEQ ID NO: 129002 - RNA, 1701 nt, Artificial Sequence
  derived and/or modified sequence opt3 from hemagglutinin__InfluenzaA__AEK98382
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaaguuuaaguauccagcacugaacgugaccaugcccaacaaugagaaauucgacaaacuuuacauuuggggaguccaccauccuggcacagauaacgaccagaucuuuuuguaugcccaggcuaguggccguauuacugugagcaccaagagaucucaacagacaguaaucccaaauauaggguccaggccccggauucgcaacaucccuucaagaauuagcaucuacuggaccaucguuaagccaggagauauucugcuaauaaauaguacggguaaccucaucgccccgaggggcuacuucaaaauucagaucgggaagucuuccauaaugcggagcgacgcgcccauuggaaaguguaauucggaaugcaucacuccuaacggcucuaucccaaaugacaaacccuuucagaacgugaaucgcauuacauauggugcauguccucgauacgucaagcaaaacacccugaaacuugccacugggaugagaaaugugccagagaagcagacaaggggaaucuucggcgcuauugccggcuuuauagaaaacgggugggagggaaugguggaugguugguauggcuuccggcaccaaaauuccgaggggaucggacaggcagcugaccugaaaucaacccaggccgcgauugaucagaucaacggcaaguugaaccgucucaucgguaaaacgaaugaaaaguuccaccagauugagaaggaauuuagugaggucgaagggcgcauacaagaccuggagaaauacguugaggauaccaagaucgacuuauggagcuauaacgccgaacugcucguggcacuugagaaucagcauacaauugaucugacugacuccgaaaugaacaaauuguucgagaagaccaaaaagcagcuaagagaaaaugcugaggauaugggcaacggaugcuuuaagaucuaccacaaaugugacaaugccugcauuggcucuaucaggaacgggacauaugaucaugacguauaccgggacgaggcucugaauaaccgauuccagauaaagggaguggaacucaaaagcgguuacaaggauuggauccuguggauuucauuugccaucaguugcuuccuucugugugucgcauugcucggcuuuauuaugugggccugccaaaaagggaauauccgcuguaacauaugcauuuga

SEQ ID NO: 129003 - RNA, 1701 nt, Artificial Sequence
  derived and/or modified sequence opt3 from hemagglutinin__InfluenzaA__AEK98386
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggacacggguucgcaacauucccagcagagugaguaucuauuggaccauugucaaaccuggagacauccugcuaaucaauucuacggguaaccucauugcgccaaggggcuacuucaagauacgguccgggaaaagcucgaucaugcgcucugaugcaccgauuggaaaguguaauuccgccugcaucacucccaacggcucaauaccuaaugacaagccauuucagaacgugaaucgaauuacauacggugcuugucccagauaugugaaacaaaacacccugaaacuugccacugggaugaggaaugucccugaaaaacagacacggggaaucuucggcgcaaucgcuggcuuuauugagaacgggugggaaggaaugguugacgguugguacggcuuccgucaccagaauagugaggggcgcggacaagccgcggaucuuaagagcacccaggccgcaaucgaccagauuaacggcaaauugaacagacucauagguaagacgaaugagaaauuccaucagaucgaaaaggaguuuuccgaaguggaggggaggauucaagaucuggaaaaguauguagaggacaccaaaaucgauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagauuuaucauaagugugauaaugccugcauaggcucaauccgaaacgggacauacgaccacgaugucuaucgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 129004 - RNA, 1701 nt, Artificial Sequence
  derived and/or modified sequence opt3 from hemagglutinin__InfluenzaA__AEK98388
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggacugcaaaacaagaaaugggauuuguuuguggaaagauccaaggccuauucuaauuguuaccccuaugacgucccugauuacgcaucgcucaggucacugguggccagcaguggcacucuggaguucaacaaugaauccuuuaacuggacagguguuacccagaaugggacgucuagcgcuugcauccggcgcuccaagaacucauucuuuagucgacucaauugguuaacucaucugaacuucaaauauccagcacuuaaugugaccaugcccaacaacgagcaguuugacaaguuguacauuuggggaguccaccauccuggcacagauaaagaccagaucuuccuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccuacucauuaauucuacggguaaccugauagcgccgaggggcuacuuuaagauccgguccgggaaaagcucgauuaugcgcucugacgcacccaucggaaaauguaauuccgagugcauaacuccuaacggcucaauuccaaaugacaagcccuuccagaacgugaaucgaaucacauauggugccuguccuagauacgucaaacaaaacacccuuaagcuggcuacugggaugaggaaugugccagaaaaacagacacggggaaucuuuggcgccauugcaggcuucaucgagaacgggugggaaggaaugguggaugguugguauggcuuucgucaccagaauagugaggggcgcggacaagcugccgaccucaagagcacccaggcggccauugaucagauaaacggcaaauugaauagacugaucgguaagacgaacgagaaguuccaccagauugaaaaagaguucuccgaagucgaggggaggauccaagacuuagaaaaguacguugaggauaccaaaaucgaccuguggucuuauaacgcagagcuccuuguggcucuggaaaaucagcauacaauugauuugacugacagcgagaugaacaagcuauuugaaaagaccaagaagcagcugcgggagaaugccgaagauaugggcaacggaugcuucaaaauauaccacaagugugacaaugcuugcaucggcucaauucgaaacgggacauaugaucaugacguauaccgcgacgaggcccucaauaacagauuucagaucaaaggaguggagcugaagagugguuacaaagauuggauucuuuggaucuccuucgcaauaagcugcuuucuguugugugucgcccuccugggcuucaucaugugggcuugccaaaaggggaauauuagguguaacaucugcauuuga

SEQ ID NO: 129005 - RNA, 1701 nt, Artificial Sequence
  derived and/or modified sequence opt3 from hemagglutinin__InfluenzaA__AEK98390
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccagcacugaacgugaccaugcccaauaacgaacaguucgauaagcuguauauuuggggaguccaucacccuggcacagacaaggaucagaucuuuuuguacgcccaagcuagcggccguauuacugugucuaccaaaagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugaugcacccauugggaaauguaaguccgccugcaucacgccuaauggcucaauaccaaacgacaagacuuuucagaaugugaaccgaauuacauacggugcuugucccagauaugugaaacaaaauacccugaaacuugccacugggaugaggaacgucccugagaagcagacacggggaaucuucggcgcaaucgcuggcuuuauugaaaaugggugggagggaaugguugacgguugguacggcuuccgucaccagaacagugaggggcgcggacaagccgcggaucuuaagagcacccaggccgcaaucgaccagauuaauggcaaauugaacagacucauagguaagacgaacgaaaaauuccaucagaucgagaaggaauuuuccgagguggaagggaggauucaagaucuggagaaguauguagaggacaccaaaaucgauuuauggucuuacaaugcugaacugcucguggcccuugagaaccagcacacaaucgaccugacugauagcgaaaugaauaaguuguucgagaaaaccaagaaacagcuacgggaaaacgcugaggacaugggcaauggaugcuuuaagauuuaucauaagugugauaacgccugcauaggcucaauccgaaaugggacauacgaccacgaugucuaucgcgacgaggcacugaacaauagauuccagauuaaaggaguggaacucaagagugguuacaaagacuggauccuguggauuuccuuugccaucagcugcuuccuucuguguguugcuuugcucggcuuuauaaugugggcgugccaaaaggggaacaucagguguaauauuugcaucuga

SEQ ID NO: 129006 - RNA, 1701 nt, Artificial Sequence
  derived and/or modified sequence opt3 from hemagglutinin__InfluenzaA__AEK98392
augaagaccaucauugcccugagcuacauacucugccuuguguucgcucagaaacugcccggcaacgacaauuccacagcaacuuuguguuuagggcaccaugccgucccuaacggaacgaucguuaagaccauuacagaugaccaaaucgaggugacuaaugcgaccgaacugguacagucuucaaguacaggugagauuugcaacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugagaacuucaauuggacagguguuacccagaacgggacguccucugcuugcauccggcgcagcaauaacuccuuuuucucacgacugaauuggcucacucacuuaaacuuuaaguacccagcacugaacgugaccaugcccaauaacgagcaguucgacaaacuuuauauuuggggaguccaucacccuggcacagauaaagaccagaucuuuuuguacgcccaagcuaguggccguauuacugugagcaccaagagaucucagcaggccguaaucccaaauauaggguccaggcugcggguucgcaacauucccucaagagugagcaucuauuggacaauugucaaaccuggagauauccuacucaucaauaguaccgguaaccugauugcgccaaggggcuacuucaagauacggucugggaaauccagcaucaugcgcucggacgcaccgauuggaaaguguaauucugccugcaucacgcccaacggcuccauaccuaaugacaagccauuucagaacgugaaucgaauuacuuacggugcuugucccagauaugugaaacaaaacacacuuaagcuggccaccgggaugaggaaugucccugaaaaacagacucggggaaucuucggcgcaaucgcuggcuuuauugagaacgggugggaaggaaugguugaugguugguacggcuuccgucaccaaaauucagaggggcgcggacaggccgcggacuugaagaguacacaggccgcaaucgaucagauuaacggcaaacucaacagacugauagguaagaccaaugagaaauuccaucagaucgaaaaggaguuuagcgaaguggaggggaggauucaagacuuagaaaaguauguagaggauacgaaaaucgaccugugguccuacaacgcugagcuccuuguggcccuggaaaaucagcacaccaucgauuugacagacucugagaugaacaagcuauucgaaaagacuaagaaacagcugcgggagaaugcugaagauaugggcaacggaugcuuuaagauuuaucauaagugugacaaugccugcauaggcagcauccgaaacgggaccuacgaucacgacgucuaucgcgacgaggcacucaauaacagauuccagauuaaaggaguggagcugaagucagguuacaaagauuggauccuuuggauuaguuuugccaucuccugcuuccuguuguguguugcucuccugggcuuuauaaugugggcgugccaaaaggggaauaucagguguaacauuugcaucuga

SEQ ID NO: 129007 - RNA, 1701 nt, Artificial Sequence
  derived and/or modified sequence opt3 from hemagglutinin__InfluenzaA__AEK98394
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagagaucccagcaggccguaaucccaaauauagggucaaggcugcggguucgcaacauucccagcagagugaguaucuauuggacaauugucaaaccuggagacauccuacucaucaauucuaccgguaaccugauugcgccaaggggcuacuucaagauacgguccgggaaaagcucgaucaugcgcucugaugcaccgauuggaaaguguaauuccgccugcaucacgcccaacggcucaauaccuaaugacaagccauuucagaacgugaaucgaauuacuuacggugcuugucccagauaugugaaacaaaacacacuuaagcuggccaccgggaugaggaaugucccugaaaaacagacucggggaaucuucggcgcaaucgcuggcuuuauugagaacgggugggaaggaaugguugacgguugguacggcuuccgucaccagaauagugaggggcgcggacaagccgcggaucucaagagcacacaggccgcaaucgaccagauuaacggcaaauugaacagacugauagguaagaccaaugagaaauuccaucagaucgaaaaggaguuuuccgaaguggaggggaggauucaagauuuagaaaaguauguagaggacacgaaaaucgaucuguggucuuacaacgcugagcuccuuguggcccuggaaaaucagcacaccaucgacuugacagauagcgagaugaacaagcuauucgaaaagacuaagaaacagcugcgggagaaugcugaagacaugggcaacggaugcuuuaagauuuaucauaagugugauaaugccugcauaggcucaauccgaaacgggaccuacgaccacgaugucuaucgcgacgaggcacucaauaacagauuccagauuaaaggaguggagcugaagagugguuacaaagacuggauccuuuggauuuccuuugccaucagcugcuuccuguuguguguugcucuccugggcuuuauaaugugggcgugccaaaaggggaauaucagguguaacauuugcaucuga

SEQ ID NO: 129008 - RNA, 1701 nt, Artificial Sequence
  derived and/or modified sequence opt3 from hemagglutinin__InfluenzaA__AEK98396
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaagucauuuuucagucgacugaauuggcucacucauuuaaaguuuaaauauccagcacugaacgugaccaugcccaauaacgagcaguucgacaaacuuuacauuuggggaguccaccauccuggcacagauaacgaccagaucagcuuguaugcccaggcuucuggccguauuacuguguccaccaagagaucacaacagacaguaaucccaaauauagggagcaggccccggguucgcaacauuccuaguagaaucucuauuuacuggaccaucgugaagccaggagauauccugcuaauuaauuccacggguaaccucauagccccgaggggcuacuuuaaaauccggagcgggaagucgucuauuaugcgcuccgacgcgcccaucggaaaguguaauucagaaugcauaacuccuaacggcaguauuccaaaugacaaacccuuccagaacgucaaucgaaucacauauggugcauguccuagauacgugaagcaaaacacccugaaacuugccacugggaugaggaaugugccagagaagcagacacggggaaucuuuggcgcuauugccggcuucaucgaaaacgggugggagggaauggucgaugguugguauggcuuucgucaccagaauagcgaggggcgcggacaagcagcugaccugaaauccacccaggccgcgauugaucagauaaacggcaaguugaauagacucaucgguaaaacgaacgaaaaguuccaccagauugagaaggaguucucugaaguugaagggaggauccaagaccuggagaaauacguggaggauaccaagaucgacuuauggagcuauaacgccgaacugcucguagcacuugagaaucagcauacaauugaucugacugacucagaaaugaacaaauuguuugagaagaccaaaaagcagcuacgggaaaaugcugaggauaugggcaacggaugcuucaagauauaccacaaaugugacaaugccugcaucggcaguauucgaaacgggacauaugaucaugacguguaccgcgacgaggcucugaauaacagauuucagaucaagggagucgaacucaaauccgguuacaaggauuggauucuguggaucagcuucgccauaucuugcuuucuucuguguaucgcauugcucggcuucauuaugugggccugccaaaaagggaauaucagguguaacauuugcaucuga

SEQ ID NO: 129009 - RNA, 1701 nt, Artificial Sequence
  derived and/or modified sequence opt3 from hemagglutinin__InfluenzaA__AEK98398
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggacugcaaaacaagaaaugggauuuguuuguggaaagauccaaggccuauucuaauuguuaccccuaugacgucccugauuacgcaucgcucaggucacugguggccagcaguggcacucuggaguucaacaaugaauccuuuaacuggacagguguuacccagaaugggacgucuagcgcuugcauccggcgcuccaagaacucauucuuuagucgacucaauugguuaacucaucugaacuucaaauauccagcacuuaaugugaccaugcccaacaacgagcaguuugacaaguuguacauuuggggaguccaccauccuggcacagauaaagaccagaucuuccuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccuacucauuaauucuacggguaaccugauagcgccgaggggcuacuuuaagauccgguccgggaaaagcucgauuaugcgcucugacgcacccaucggaaaauguaauuccgagugcauaacuccuaacggcucaauuccaaaugacaagcccuuccagaacgugaaucgaaucacauauggugccuguccuagauacgucaaacaaaacacccuuaagcuggcuacugggaugaggaauaucccagaaaaacagacacggggaauuuuuggcgccaucgcaggcuucauugagaacgggugggaaggaaugguggaugguugguauggcuuucgucaccagaauagugaggggcgcggacaagcugccgaccucaagagcacccaggcggccauagaucagaucaacggcaaauugaauagacugauugguaagacgaacgagaaguuccaccagaucgaaaaagaguucuccgaaguggaggggaggauccaagacuuagaaaaguacgucgaggauaccaaaauugaccuguggucuuauaacgcagagcuccuuguugcucuggaaaaucagcauacaauagauuugacugacagcgagaugaacaagcuauuugaaaagaccaagaagcagcugcgggagaaugccgaagauaugggcaacggaugcuucaaaaucuaccacaagugugacaaugcuugcauuggcucaauccgaaacgggacauaugaucaugacguguaccgcgacgaggcccucaauaacagauuucagauuaaaggaguagagcugaagagugguuacaaagauuggaucauauggaucuccuucgcaauuagcugcuuucuucuguguguggccuugcucggcuucaucaugugggcuugccaaaaggggaauauuagguguaacaucugcauauga

SEQ ID NO: 129010 - RNA, 1701 nt, Artificial Sequence
  derived and/or modified sequence opt3 from hemagglutinin__InfluenzaA__AEK98400
auggagaccaucauugcccugagcuacauacucucccuuguguucgcucagaagcugcccggcaacgacaauucuacagcaacuuugugcuuagggcaccaugccgucccuaacggaacgaucguuaaaaccauuacaaaugaucaaaucgaagugacuaacgcgaccgagcugguacagucaaguagcacaggugaaauuugugacuccccacaccagauccuagauggcgagaauugcacccucauagacgcucugcuuggggauccgcagugugacggauuucaaaacaagaaaugggaucuguucguggaaagaucuaaggccuauucgaauugcuaccccuaugacgucccugauuacgcaucauugaggagccucguggccaguuccggcacucuggaguuuaacaaugagaacuucaauuggacagguguuacccagaacgggacgucuagcgcuuguauccggcgcuccaauaacucauuuuucagucgacugaauuggcucacucauuuacguuuuaaauauccagcacugaacgugaccaugcccaacaaugaagaguucgacaaacuuuacauuuggggaguccaccauccuggcacagauaacgaccagaucuuuuuguaugcccaggcuagcggcagaauuacugugucuaccaagaggucccaacagacaguaaucccaaauauagggucacggccccgcguuagaaacauuccuagcaggaucaguauuuacuggaccaucgugaagccaggagauauccugcuaauuaauucuacggguaaccucauagccccgcggggcuacuucaagauccgcuccgggaaaagcucgauuaugcgaucugacgcgcccaucggaaagugcuccucagaauguauaacuccuaauggcaguauuccaaacgacaaacccuuucagaaugucaacagaaucacauauggugcaugcccuagguacgugaagcagaauacccugaaacuugccacugggaugcggaacgugccagagaagcaaacacguggaaucuucggcgcuauugccggcuuuaucgagaaugggugggaaggaauggucgaugguugguauggcuuccgccaccagaacagcgaggggauuggacaggcagcugaccugaaguccacccaagccgcgauagaucagaucaauggcaaauugaacagacucauugguaagacgaacgaaaaauuccaccagaucgagaaggaauuuucugagaucgaggggaggauucaggaccuggaaaaauacguugaggauaccaagauagacuuauggagcuauaaugccgaacugcucguggcacuugagaaccaacauacaaucgaucugacugacucagaaaugaauaaguuguucgagaaaaccaagaaacagcuacgggagaacgcugaagauaugggcaauggauguuuuaagauuuaccacaaaugcgacaacgccuguaucggcaguauucgaaaugggacauaugaucaugacguauaccgcgacgaggcucugaacaauagauuccagaucaagggaguggaacucaaguccgguuacaaagauuggauacuguggaucagcuuugccauuucuugcuuccuucugugcgucgcauugcucggcuuuaucaugugggccugucagaaggggaacauuaggugcaauaucuguauauga

SEQ ID NO: 129011 - RNA, 1701 nt, Artificial Sequence
  derived and/or modified sequence opt3 from hemagglutinin__InfluenzaA__AEK98402
augaagaccaucauugcccugagcuacauacucugccuuggcuucgcucagaaacugcccgggaacgacaauuccacagcaacuuuguguuuaggacaccaugccgugccuaacgguacgaucgucaagaccauuacaaaugaucaaaucgagguuacuaacgcgaccgaacuggugcagucuucaaguacaggcgagauuugcgacagcccacaccagauccuagaugggaaaaauuguacccucauagacgcucugcuuggagauccgcagugcgacggcuuucaaaacaagaaaugggaucuguucguagaaagauccaaggccuauucuaauuguuaccccuaugacgugccugauuacgcaucguugaggucacucgucgccagcagugguacucuggaguuuaacaaugaauccuucaacuggacaggggugacccagaauggaacgucuagcgcuugcauccggcgcuccaagaacucauuuuucagucgacugaauuggcucacucauuuaaacuuuaaauauccagcacugaauguuaccaugcccaacaacgagcaguucgacaagcuguacauuuggggcgugcaccauccuggcacagauaaagaccagaucuuuuuguaugcccaagcuagcgggcguauuacugucucuaccaagagaucccagcagacagccaucccaaauauaggaucaaggccccgggugcgcaacauuccuagcagaaucaguauuuacuggaccaucguaaaaccaggugauauccugcuaauuaauucuacgggcaaccucauagcgccgaggggguacuucaagauccgguccggaaagagcucgauuaugcgcucugacgcacccaucggcaaauguaauuccgagugcauaacuccuaacgguucaauuccaaaugacaagcccuuucagaacguuaaucgaaucacauauggggccuguccuagauacgugaaacaaaacacccugaaacuugcuacuggaaugaggaaugucccagaaaaacagacacggggcaucuucggcgccauugcaggguuuaucgagaacggaugggaagguaugguggauggcugguauggguuccgucaccagaauagugagggacgcggccaagcugccgaccuuaagagcacccaggcggccauuaaccagauaaaugguaaauugaacagacucaucgggaagacgaacgagaaguuccaccagauugaaaaagaguuuuccgaaguggagggcaggauccaagaucuggaaaaguacgucgaggacaccaaaaucgauuuauggucuuauaaugcagagcugcucguugcucuugaaaaccagcauacaauugaccugacugauagcgagaugaauaaguuguucgaaaagaccaagaagcagcuacgggagaacgccgaagacaugggaaauggcugcuuuaaaauauaccacaagugugauaacgcuugcaucgggucaauucgaaauggaacauaugaccaugauguguaccgcgacgaggcccugaacaauagauuccagaucaaagguguagagcucaagaguggcuacaaagacuggauucuguggaucuccuuugcaauaagcugcuuccuucuguguguggccuugcucggguuuaucaugugggcuugccaaaagggaaacauuagguguaauaucugcauuuga

SEQ ID NO: 129012 - RNA, 1701 nt, Artificial Sequence
  derived and/or modified sequence opt3 from hemagglutinin__InfluenzaA__AEK98404
augaagaccaucauugcccugagcuacauacucucccuuguguucgcucagaaacugcccggcaacgacaauucuacagcaacuuugugcuuagggcaccaugccgucccuaacggaacgaucguuaagaccauuacaaaugaucaaaucgaggugacuaacgcgaccgaacugguacagucaaguagcacaggugagauuugugacuccccacaccagauccuagauggcgaaaauugcacccucauagacgcucugcuuggggauccgcagugugacggauuucaaaacaaaaagugggaucuguucguggagagaucuaaagccuauucgaauugcuaccccuaugacgucccugauuacgcaucauugaggagccucguggccaguuccggcacucuggaauuuaacaaugagaacuucaauuggacagguguuacccagaacgggacgucuagcgcuuguauccggcgcuccaauaacucauuuuucagucgacugaauuggcucacucauuuacguuuuaaguauccagcacugaacgugaccaugcccaacaaugaggaguucgacaaacuuuacauuuggggaguccaccauccuggcacagauaacgaccagaucuuuuuguaugcccaggcuagcggcagaauuacugugucuaccaagaggucccaacagacaguaaucccaaauauagggucacggccccgcguuagaaacauuccuagcaggaucaguauuuacuggaccaucgugaagccaggagauauccugcuaauuaauucuacggguaaccucauagccccgcggggcuacuucaaaaugcgcuccggaaagagcucgaucaugcgaucugacgcgcccauugggaaaugcaauuccgaauguaucacuccuaacggcucaauaccaaaugacaagcccuuucagaacgucaauagaauuacauauggugcaugcccuagguacgugaagcagaacacccugaaacuugccacugggaugcggaaugugccagaaaagcaaacacguggaaucuucggcgcuaucgccggcuuuauugagaacgggugggagggaauggucgaugguugguauggcuuccgccaccagaauagugaagggaucggacaggcagcugaccugaaaagcacccaagccgcgauugaucagauaaacggcaaguugaacagacucaucgguaaaacgaaugagaaguuccaccagauugaaaaagaguuuuccgaaguugaggggaggauccaggaccuggagaaguacguggaagauaccaagaucgacuuauggucuuauaacgccgagcugcucguagcacuugaaaaucaacauacaauugaucugacugacagcgagaugaacaaauuguucgaaaagaccaaaaagcagcuacgggagaaugcugaggauaugggcaacggauguuuuaaaauauaccacaagugcgacaaugccuguaucggcucaauucgaaacgggacauaugaucaugacguguaccgcgacgaagcucugaauaacagauuccagaucaagggagucgagcucaaaagugguuacaaggauuggauucuguggaucuccuuugccauaagcugcuuccuucugugcguggcauugcucggcuuuaucaugugggccugucagaaagggaauauuaggugcaacaucuguauuuga

SEQ ID NO: 129013 - RNA, 1701 nt, Artificial Sequence
  derived and/or modified sequence opt3 from hemagglutinin__InfluenzaA__AEK98406
augaagaccaucauugcccugagcuacauacucucccuuguguucgcucagaaacugcccggcaacgacaauucuacagcaacuuugugcuuagggcaccaugccgucccuaacggaacgaucguuaagaccauuacaaaugaucaaaucgaggugacuaacgcgaccgaacugguacagucaaguagcacaggugagauuugugacuccccacaccagauccuagauggcgaaaauugcacccucauagacgcucugcuuggggauccgcagugugacggauuucaaaacaaaaagugggaucuguucguggagagaucuaaagccuauucgaauugcuaccccuaugacgucccugauuacgcaucauugaggagccucguggccaguuccggcacucuggaauuuaacaaugagaacuucaauuggacagguguuacccagaacgggacgucuagcgcuuguauccggcgcuccaauaacucauuuuucagucgacugaauuggcucacucauuuacguuuuaaguauccagcacugaacgugaccaugcccaacaaugaggaacuugacaaguuguacauuuggggaguccaccauccuggcacagauaacgaccagaucuuccuguaugcccaggcuagcggcagaauuacugugucuaccaaaaggucccaacagacaguaaucccaaauauagggucacggccccgcguuagaaacauuccuagcaggaucaguauuuacuggaccaucgugaagccaggagauauccuacucauuaauucuacggguaaccugauagccccgcggggcuacuuuaaaauccgcuccggaaagagcucgauuaugcgaucugacgcgcccaucgggaaaugcaauuccgaguguauaacuccuaacggcucaauuccaaaugacaagcccuuccagaacgucaauagaaucacauauggugcaugcccuagguacgugaagcagaacacccuuaaacuggccacugggaugcggaaugugccagaaaagcaaacacguggaaucuuuggcgcuauugccggcuucaucgagaacgggugggagggaauggucgaugguugguauggcuuucgccaccagaauagugaagggauuggacaggcagcugacuugaaaagcacccaagccgcgauagaucagaucaacggcaagcucaacagacugauugguaaaacgaaugagaaguuccaccagaucgaaaaagaguucuccgaaguugaggggaggauccaggacuuagagaaguacguggaagauaccaagauugaccuguggucuuauaacgccgagcuccuuguagcacuggaaaaucaacauacaauagauuugacugacagcgagaugaacaaacuauuugaaaagaccaaaaagcagcugcgggagaaugcugaggauaugggcaacggauguuucaaaaucuaccacaagugcgacaaugccuguauuggcucaauccgaaacgggacauaugaucaugacguguaccgcgacgaagcucucaauaacagauuucagauuaagggagucgagcugaaaagugguuacaaggauuggauccuuuggauauccuucgccaucagcugcuuucuguugugcguggcacuccugggcuucguuaugugggccugucagaaagggaauauuaggugcaacaucuguauuuga

SEQ ID NO: 129014 - RNA, 1701 nt, Artificial Sequence
  derived and/or modified sequence opt3 from hemagglutinin__InfluenzaA__AEL11687
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcuccugcaagcggcgcucaaacaauagcuuuuucagccgacugaacuggcucacucauuuaaaguuuaaauauccagcucugaaugugaccaugcccaacaacgagaaguucgacaaacuuuacaucuggggcguccaccauccugugacagauaaugaccagauucguuuguaugcacaggccucuggcagaaucacuguauccaccaagaggucacaacagacaguuauuccaaacaucggguaccggccccgcgugagagauauaccuagcaggauuaguaucuacuggaccauugucaaaccaggagacauccugcuaaucaauucuacggguaaccucauugcuccgcggggcuauuuuaagauacgcuccgggaagaguucgaucaugcgaucugacgcccccauuggaaaauguaauuccgagugcaucacuccuaacggcucaauaccaaaugauaagcccuuccagaacgugaauagaauuacauacggugcguguccuagguaugugaaacagaacacccugaagcuggcaacugggaugcggaaugucccagaaaaacaaacacguggaaucuuuggcgccaucgcuggcuucauugagaacgggugggaaggaaugguugacgguugguacggcuuucgccaccagaauagugaggggaucggacaggccgcagaucuuaagagcacccaagcugccauuaaccagauaaauggcaaauugaacagacucaucgguaagacgaacgagaaguuccaccagauugaaaaagaguucuccgaaguggaggggaggauccaggaccuggaaaaguauguagaggauaccaaaaucgacuuauggucuuacaaugcggagcugcucguggcccuugaaaaccaacauacaauugaucugacugacagcgagaugaauaaguuguuugaacggaccaaaaagcagcuacgagagaacgcagaagauaugggcaauggaugcuucaagauauaucacaaaugugacaacgcuugcaucggcucaauucgcaaugggacauacgaucaugacgucuacagagacgaggcccugaacaauagguuucagaucaagggaguggagcucaaaagugguuauaaggauuggauucuguggaucuccuucgcuauaagcugcuuucuucuguguguuguguugcucggcuucaucaugugggccugccagaaagggaacauucgguguaauaucugcauuuga

SEQ ID NO: 129015 - RNA, 1692 nt, Artificial Sequence
  derived and/or modified sequence opt3 from hemagglutinin__InfluenzaA__AEL31632
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaaguccucuuggucggaccaugaggcuucaggagucagcaguguguguccauaccagggccgguccagcuuuuuccgcaacguaguuuggcucacuaaaaaggauaaugccuaucccacaaucaaacgaucuuacaacaauaccaaccaagaagacuuacuggugcuuugggguauacaccacccuaacgaugcagccgagcagacacguuuguaucagaauccaaccacuuacauuuccgucgggacaucaacccugaaccagaggcuagugcccaagaucgcuacgagaaguaaggugaauggacaaagcggccggauggaauuuuucuggacuauucucaaaucuaacgacgcaaucaauuuugaguccaacggcaauuucaucgccccugaaaacgcuuacaagauugucaaaaagggggauucaaccauaaugaaaagcgagcuggaauauggaaauugcaacacaaagugucagacuccaaucggugccauuaauaguucuaugccguuucauaacauccacccccuuaccauaggcgagugcccuaaauacguuaaguccaaucgccugguguuggcgacagggcucagaaacagcccacagggagagaccaggggccuguucggugcaauugccggguuuaucgaaggaggcuggcagggcaugguagacgggugguauggauaccaucacucgaaugagcaagguucuggcuaugcugccgacaaggaauccacgcagaaagcaaucgauggggugacuaacaaggucaacucaauuaucgacaaaaugaauacacaguucgaggcugugggacgggaauuuaacaauuuagagcgccgaauugagaaccugaauaagaaaauggaagauggcuuccucgacguuuggaccuacaacgccgagcuucugguguugauggaaaaugagagaacucuagauuuccacgacaguaacgucaagaaucuguaugauaaggugaggcuccaacugcgggacaacgcgaaagaacuugguaauggguguuuugaguucuaccaucguugcgauaacgaguguauggaaagcguacgcaauggcacauacgacuauccccaguacuccgaggaagccagacugaagagggaggagauaucuggaguuaaauuggaaagcaucggcaccuaucagauucucucaaucuacaguacgguggcauccagccuggcuuuagccaucauggucgcugggcuguuucuauggaugugcucuaacggaucacuccagugccggauuuguauauga

SEQ ID NO: 129016 - RNA, 1701 nt, Artificial Sequence; identical to SEQ ID NO: 128936
  derived and/or modified sequence opt3 from hemagglutinin__InfluenzaA__AEL89297

SEQ ID NO: 129017 - RNA, 1701 nt, Artificial Sequence; identical to SEQ ID NO: 128936
  derived and/or modified sequence opt3 from hemagglutinin__InfluenzaA__AEL89307

SEQ ID NO: 129018 - RNA, 1701 nt, Artificial Sequence; identical to SEQ ID NO: 128936
  derived and/or modified sequence opt3 from hemagglutinin__InfluenzaA__AEL89317

SEQ ID NO: 129019 - RNA, 1701 nt, Artificial Sequence; identical to SEQ ID NO: 128936
  derived and/or modified sequence opt3 from hemagglutinin__InfluenzaA__AEL89327

SEQ ID NO: 129020 - RNA, 1701 nt, Artificial Sequence; identical to SEQ ID NO: 128936
  derived and/or modified sequence opt3 from hemagglutinin__InfluenzaA__AEL89337

SEQ ID NO: 129021 - RNA, 1701 nt, Artificial Sequence; identical to SEQ ID NO: 128936
  derived and/or modified sequence opt3 from hemagglutinin__InfluenzaA__AEL89347

SEQ ID NO: 129022 - RNA, 1701 nt, Artificial Sequence; identical to SEQ ID NO: 128936
  derived and/or modified sequence opt3 from hemagglutinin__InfluenzaA__AEL89357

SEQ ID NO: 129023 - RNA, 1701 nt, Artificial Sequence; identical to SEQ ID NO: 128936
  derived and/or modified sequence opt3 from hemagglutinin__InfluenzaA__AEL89367

SEQ ID NO: 129024 - RNA, 1701 nt, Artificial Sequence; identical to SEQ ID NO: 128936
  derived and/or modified sequence opt3 from hemagglutinin__InfluenzaA__AEL89391

SEQ ID NO: 129025 - RNA, 1701 nt, Artificial Sequence; identical to SEQ ID NO: 128936
  derived and/or modified sequence opt3 from hemagglutinin__InfluenzaA__AEL89401

SEQ ID NO: 129026 - RNA, 1701 nt, Artificial Sequence; identical to SEQ ID NO: 128936
  derived and/or modified sequence opt3 from hemagglutinin__InfluenzaA__AEL89411

SEQ ID NO: 129027 - RNA, 1701 nt, Artificial Sequence; identical to SEQ ID NO: 128936
  derived and/or modified sequence opt3 from hemagglutinin__InfluenzaA__AEL89421

SEQ ID NO: 129028 - RNA, 1701 nt, Artificial Sequence; identical to SEQ ID NO: 128936
  derived and/or modified sequence opt3 from hemagglutinin__InfluenzaA__AEL89441

SEQ ID NO: 129029 - RNA, 1701 nt, Artificial Sequence; identical to SEQ ID NO: 128936
  derived and/or modified sequence opt3 from hemagglutinin__InfluenzaA__AEL89451

SEQ ID NO: 129030 - RNA, 1701 nt, Artificial Sequence; identical to SEQ ID NO: 128936
  derived and/or modified sequence opt3 from hemagglutinin__InfluenzaA__AEL89461

SEQ ID NO: 129031 - RNA, 1701 nt, Artificial Sequence; identical to SEQ ID NO: 128936
  derived and/or modified sequence opt3 from hemagglutinin__InfluenzaA__AEL89471

SEQ ID NO: 129032 - RNA, 1701 nt, Artificial Sequence
  derived and/or modified sequence opt3 from hemagglutinin__InfluenzaA__AEL89481
augaaggugauccuggucguucuccuuuacaccuucgccacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguuaaaaagggaaacagcuacccaaaauuaucuaaguccuauauaaaugacaagggcaaagaaguacuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacaagaucacgaauaaaguuaacucugugauagagaagaugaauacccaguuuacagccgucgguaaggaguucaaccaccuggaaaaacggauugagaauuuaaacaagaaaguggaugacggguuccuggauaucuggacuuacaaugcugaacuccuuguacuguuggagaacgaacgcacccuagacuaucaugauagcaauguuaagaaccuguacgagaaagugcgaucacagcucaagaacaaugccaaggagaucggcaacggauguuuugaguucuaucacaaaugcgacaauacauguauggaaagugucaagaacggcacuuacgauuauccuaaauacuccgaagaggcaaagcugaauagagaagagauugacggggugaaacuugagagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 129033 - RNA, 1701 nt, Artificial Sequence; identical to SEQ ID NO: 127600
  derived and/or modified sequence opt3 from hemagglutinin__InfluenzaA__AEL89491

SEQ ID NO: 129034 - RNA, 1701 nt, Artificial Sequence
  derived and/or modified sequence opt3 from hemagglutinin__InfluenzaA__AEL89501
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgaugaaggcaaggagguacugguucuuuggggcauccaccaccccucaacgagcgcugaccaacagaguuuguaccagaaugccgaugcguacguguucgucgggacuucucgcuauuccaaaaaguuuaaaccugagauugcaauccgaccaaaggugcgugaccaggaaggaagaaugaacuacuauuggacccugguggagcccggugauaaaauuacauucgaagccacuggcaaucuagucguuccuagguacgcuuuugccauggagcggaacgcagggagcggaaucauaauuucggacaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgauggcugguacggguaucaucaccagaacgagcaaggaagcggcuacgcagcugaccucaaguccacccagaaugccauugauaaaaucacgaacaagguaaauucuguuauagagaaaaugaacacccaguuuacagcuguggguaaggaguucaaucaccuggagaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129035 - RNA, 1701 nt, Artificial Sequence; identical to SEQ ID NO: 125849
  derived and/or modified sequence opt3 from hemagglutinin__InfluenzaA__AEL89511

SEQ ID NO: 129036 - RNA, 1701 nt, Artificial Sequence; identical to SEQ ID NO: 127600
  derived and/or modified sequence opt3 from hemagglutinin__InfluenzaA__AEL89521

SEQ ID NO: 129037 - RNA, 1701 nt, Artificial Sequence
  derived and/or modified sequence opt3 from hemagglutinin__InfluenzaA__AEL89531
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuaugucagcucagaggaguggcgccccugcaucuugguaagugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcaacugagcaguguguccucuuucgaacgguuugagauguucccgaaaaccagcuccuggcccaaucacgauucaaacaagggugucacggcagccuguccucaugcuggggcaaagaguuuuuauaaaaaucugauuuggcucgugaagaaaggaaacagcuacccaaaguuaucuaaauccuauaucaaugacaagggcaaggaaguacugguucuuuggggcauacaccaccccucaacuagcgccgaucagcagaguuuguaccagaacgcugacgccuacguguucgucgggaccucucgcuauuccaaaaaguuuaaaccugagaucgcgauucgaccaaaggugcgugaucaagagggaagaaugaauuacuauuggacacugguggaacccggugacaaaaucacuuucgaggcaaccggcaaccuagucguuccuagguacgccuuugcuauggaacggaacgccgggagcggaauuaucauaucggauacaccagugcaugacugcaauaccacgugucagacuccgaagggcgcaauuaacacaucucuccccuuccagaauauccacccuauuaccaucgguaaaugcccaaaguauguaaaguccacuaaacugcgccuugcuacagggcugagaaacgugcccucaauccagaguaggggauuguuuggcgccauugcgggcuucauagaagggggauggaccgguauggucgacggcugguacggguaucaucaccaaaaugaacagggaagcggcuacgccgcagaucucaaguccacgcagaacgcuaucgacaaaauuaccaauaaggugaacucuguuaucgagaaaaugaauacacaguuuacugccguggguaaggaguucaaccaccuggaaaagcggauagagaauuuaaacaaaaaggucgaugacggguuccuggauauuuggaccuacaaugcugaacuccuugugcuguuggagaacgaacgcacacuagacuaucaugauagcaauguaaagaaccuguacgagaagguucgaucacaacucaaaaacaaugccaaggagaucggcaacggauguuuugaguucuaucacaagugcgacaauacuuguauggaaagugugaaaaacggcaccuacgauuauccuaaguacuccgaagaggcaaaacugaauagagaagagaucgacggggucaaacuugagagcacaaggauuuaucagauccuggccauuuacucuaccguggcuucaaguuugguccucgugguuagccugggagcgauauccuuuuggaugugcucuaacgguucguuacagugccggaucuguauuuga

SEQ ID NO: 129038 - RNA, 1701 nt, Artificial Sequence; identical to SEQ ID NO: 127600
  derived and/or modified sequence opt3 from hemagglutinin__InfluenzaA__AEL89541

SEQ ID NO: 129039 - RNA, 1701 nt, Artificial Sequence
  derived and/or modified sequence opt3 from hemagglutinin__InfluenzaA__AEL89551
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagcucaugacugcaacacaaccugucaaacgccgaaaggcgccaucaauacuucucuccccuuccagaacauucacccuaucacaaucgguaagugcccaaaguaugugaaauccaccaagcugcgccuugcgacugggcugagaaauguacccucaauucagaguaggggauuguuuggcgccauagcaggcuucaucgaagggggauggacagguaugguggauggcugguacggguaucaucaccagaacgaacaaggaagcggcuacgcugccgaccucaaauccacccagaaugcuauugauaagaucacgaacaaagucaauucugugauagagaagaugaacacccaguuuacagccguugguaaggaguucaaucaccuggaaaaacggauugagaacuuaaauaagaaaguggacgauggguuccuggacaucuggacuuacaacgcagaacuccuuguccuguuggagaaugaacgcacccuagauuaucaugacagcaacgugaagaaucuguacgagaaaguacgaucacagcucaagaacaacgccaaggagaucggcaauggauguuuugaguucuaucacaaaugcgauaacacauguauggaaaguguuaagaauggcacuuacgacuauccuaaauacuccgaagaggcuaagcugaacagagaagagauugauggggugaaacuugagagcaccaggaucuaucaaauucuggcgauauacucuacagucgcaucaaguuuggugcucgucgugagccugggagccaucuccuuuuggaugugcucuaaugguucguuacagugccggauuuguaucuga

SEQ ID NO: 129040 - RNA, 1701 nt, Artificial Sequence
  derived and/or modified sequence opt3 from hemagglutinin__InfluenzaA__AEL89561
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccgaccacgauucaaauaagggggucaccgccgcuuguccucaugcaggagccaaaaguuuuuauaagaaccugaucuggcucgugaaaaagggcaauagcuacccaaaauuaucuaaguccuauauaaacgacaagggcaaagaaguacugguucuuugggggauccaccaccccucaacgagcgcugaucaacagaguuuguaccagaaugccgacgcguacguguucgucggaacuucucgcuauuccaagaaauuuaagccugagauugcaauccgaccaaaagugcgugaucaggaggguagaaugaacuacuauuggacccugguggaacccggcgacaagauuacauucgaggccacugggaaucuagucguuccuagguacgcuuuugccauggaacggaacgcaggaagcggcaucauaauuucggauaccccagugcaugacugcaacacaaccugucaaacgccgaaaggugcuaucaauacuucucuccccuuccagaacauucacccuaucacaaucgggaagugcccaaaguauguaaaauccaccaagcugcgccuugccacuggacugagaaaugugcccucaauucagaguaggggcuuguuuggcgcgauagccggguucaucgagggagguuggacaggcauggucgacgggugguacggauaucaucaccagaacgaacaaggcagcgguuacgcagcugaucucaaauccacccagaaugccauugacaagaucacgaacaaaguuaauucugugauagagaagaugaacacccaguuuacagcuguggggaaggaguucaaucaccuggaaaaacggauugagaacuuaaauaagaaagucgaugacggcuuccuggauaucuggacuuacaacgccgaacuccuugugcuguuggagaaugaacgcacccuagacuaucaugauagcaacguaaagaaucuguacgagaaaguucgaucacagcucaagaacaacgcaaaggagaucggaaauggcuguuuugaguucuaucacaaaugcgacaacacauguauggagagugugaagaaugggacuuacgauuauccuaaauacuccgaagaggccaagcugaacagagaagagauugacggagucaaacuugagagcaccgaaaucuaucaaauucuggcuauauacucuacaguggcgucaaguuugguccucgugguuagccugggugcaaucuccuuuuggaugugcucuaauggcucguuacagugcaggauuuguaucuga

SEQ ID NO: 129041 - RNA, 1701 nt, Artificial Sequence; identical to SEQ ID NO: 127600
  derived and/or modified sequence opt3 from hemagglutinin__InfluenzaA__AEL89571

SEQ ID NO: 129042 - RNA, 1701 nt, Artificial Sequence
  derived and/or modified sequence opt3 from hemagglutinin__InfluenzaA__AEL89581
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccgaucacgacucaaauaagggugucaccgccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacgagcgcugaccaacagaguuuguaccagaaugccgaugcguacguguucgucgggacuucucgcuauuccaagaaauuuaagccugagaucgcaauucgaccaaaagugcgugaccaggagggaagaaugaacuacuauuggacccugguggaacccggugauaagaucacauucgaggccacuggcaaucuagucguuccuagguacgcuuuugccauggaacggaacgcagggagcggaauuaucauaucggacaccccagugcaugacugcaacacaaccugucaaacgccgaaaggcgcuauuaauacuucucuccccuuccagaacauccacccuauuacaaucgguaagugcccaaaguauguaaaauccaccaagcugcgccuugccacugggcugagaaaugugcccucaauccagaguaggggauuguuuggcgcgauugccggcuucauagaagggggauggacagguauggucgauggcugguacggguaucaucaccagaacgaacaaggaagcggcuacgcagcugaccucaaauccacccagaaugccaucgauaagauuacgaacaaaguuaauucugugaucgagaagaugaacacccaguuuacagcuguggguaaggaguucaaucaccuggaaaaacggauagagaacuuaaauaagaaagucgacgauggguuccuggacauuuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaagagaucgauggggucaaacuugagagcaccaggauuuaucaaauccuggcuauuuacucuacaguggcgucaaguuugguccucgugguuagccugggagcaauauccuuuuggaugugcucuaaugguucguuacagugccggaucuguauuuga

SEQ ID NO: 129043 - RNA, 1701 nt, Artificial Sequence; identical to SEQ ID NO: 128470
  derived and/or modified sequence opt3 from hemagglutinin__InfluenzaA__AEL89591

SEQ ID NO: 129044 - RNA, 1701 nt, Artificial Sequence
  derived and/or modified sequence opt3 from hemagglutinin__InfluenzaA__AEL89601
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgagaucaccaauaaggugaacuccguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauucuaaaguaaagaaucuguacgagaaaguucgaagccagcucaagaacaacgccaaggaaaucggcaauggauguuuugaguucuaucacaaaugcgacaacacuuguauggaaucagugaagaauggcaccuacgauuauccaaaauacagugaggaagcaaagcugaacagagaggagauugacggggucaaacuugaauccacaaggaucuaucaaauucuggccauauacagcaccguggcuucuucauugguccucgugguuagucugggagcgaucagcuuuuggaugugcuccaaugguucuuuacagugccggauuuguaucuga

SEQ ID NO: 129045 - RNA, 1701 nt, Artificial Sequence; identical to SEQ ID NO: 128470
  derived and/or modified sequence opt3 from hemagglutinin__InfluenzaA__AEL89611

SEQ ID NO: 129046 - RNA, 1701 nt, Artificial Sequence; identical to SEQ ID NO: 128912
  derived and/or modified sequence opt3 from hemagglutinin__InfluenzaA__AEL89621

SEQ ID NO: 129047 - RNA, 1701 nt, Artificial Sequence; identical to SEQ ID NO: 127600
  derived and/or modified sequence opt3 from hemagglutinin__InfluenzaA__AEL89631

SEQ ID NO: 129048 - RNA, 1701 nt, Artificial Sequence; identical to SEQ ID NO: 128936
  derived and/or modified sequence opt3 from hemagglutinin__InfluenzaA__AEL89641

SEQ ID NO: 129049 - RNA, 1701 nt, Artificial Sequence
  derived and/or modified sequence opt3 from hemagglutinin__InfluenzaA__AEL89651
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgaugcguacgucuucguggggaccagucgcuauucuaagaaauuuaagccugagauugcaauccgaccaaaagugcgugaccaggagggaagaaugaauuacuauuggacacuggucgaacccggugauaagauuacuuucgaggccaccggcaaccuaguugugccuagguacgcuuuugccauggaacggaacgcaggguccggaaucauaauuagcgacacaccaguacaugauugcaauaccacgugucaaacuccgaaaggcgcuaucaacacaucgcuccccuuccagaauauucacccuaucaccaucgguaagugcccaaaguuugugaaaucuacuaagcugcgccuugccacagggcugagaaacguccccuccauucagucaaggggauuguucggcgcgauagccggcuuuaucgaagggggauggaccgguaugguggacggcugguauggguaccaucaccagaaugaacaaggaaguggcuaugcagcugaccucaaaagcacgcagaacgccauugauaagaucaccaauaaaguuaacuccgugauagagaagaugaauacacaguucacugcugucgguaaggaguucaaccaccuggaaaaacggauugagaauuuaaacaagaaaguggacgauggguuucuggacaucuggaccuacaaugccgaacuccuuguacuguuggagaacgaacgcacacuagauuaccaugacucuaauguuaagaaccuguaugagaaagugcgaaaccagcucaagaauaacgcaaaggagaucggcaauggauguuucgaauuuuaccacaaaugcgauaacacuuguauggagagcgucaagaauggcaccuaugacuacccuaaauauucagaagaggccaagcugaacagagaagagauugauggggugaaacuugagaguacaaggaucuaccaaauucuggcuauauauuccaccgucgcgagcucuuuggugcucguugugucacugggagcaaucaguuucuggaugugcagcaaugguuccuuacagugccggauuuguaucuga

SEQ ID NO: 129050 - RNA, 1701 nt, Artificial Sequence; identical to SEQ ID NO: 128451
  derived and/or modified sequence opt3 from hemagglutinin__InfluenzaA__AEL89661

SEQ ID NO: 129051 - RNA, 1701 nt, Artificial Sequence
  derived and/or modified sequence opt3 from hemagglutinin__InfluenzaA__AEL89671
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagagugccgacaccuacguguucgucgggacaucucgcuauuccaagaaauuuaagccugagauugcgauccgaccaaaagugcgugaucaggagggaagaaugaacuacuauuggacucugguggaacccggugacaagauuaccuucgaggcaacaggcaaucuagucguuccuagguacgccuuugcuauggaacggaacgccgggagcggaaucauaauuucggauaccccagugcaugacugcaacacgacuugucaaacaccgaaaggcgcaaucaauaccucucuccccuuccagaacauucacccuaucacuaucgguaagugcccaaaguauguaaaauccacaaagcugcgccuugcuaccgggcugagaaaugugcccucaauucagaguaggggauuguuuggcgccauagcgggcuucaucgaagggggauggacggguauggucgacggcugguacggguaucaucaccagaacgaacaaggaagcggcuacgccgcagaucucaaauccacccagaaugcuauugacaagaucacaaacaaaguuaauucugugauagagaagaugaacacucaguuuaccgccguggguaaggaguucaaucaccuggaaaaacggauugagaacuuaaauaagaaagucgaugacggguuccuggauaucuggacauacaacgcugaacuccuugugcuguuggagaaugaacgcacucuagacuaucaugauagcaacguaaagaaucuguacgagaaaguucgaaaccagcucaagaacaaugccaaggagaucggcaacggauguuuugaguucuaucacaaaugcgacaauaccuguauggaaucagugaagaacggcacauacgauuauccuaaauacagugaagaggcaaagcugaauagagaagagauugacggggucaaacuugaguccaccaggaucuaucaaauucuggccauauacagcacuguggcuucuucauugguccucgugguuagucugggagcgaucagcuuuuggaugugcuccaacgguucuuuacagugccggauuuguaucuga

SEQ ID NO: 129052 - RNA, 1701 nt, Artificial Sequence; identical to SEQ ID NO: 128451
  derived and/or modified sequence opt3 from hemagglutinin__InfluenzaA__AEL89691

SEQ ID NO: 129053 - RNA, 1701 nt, Artificial Sequence
  derived and/or modified sequence opt3 from hemagglutinin__InfluenzaA__AEL89701
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagaacuuguaccagaaugcugacgccuacguguucgucgggaccagccgcuauaguaagaaauuuaagccagagauugcgauccgacccaaagugcgugaucaggagggaagaaugaacuacuauuggacacugguggaaccuggugacaagauuacuuucgaggcaaccggcaaccuagucguuccaagguacgccuuugcuauggaacggaaugccgggucuggaaucauaauuuccgauacaccggugcacgacugcaacaccacgugucaaacucccaaaggcgcaaucaauacaagccucccuuuccagaacauucacccaaucaccaucgguaagugccccaaguauguaaaaucgacuaagcugcgccuugcuacagggcugagaaaugugccuucuauucaguccaggggauuguuuggcgccauagcgggcuucaucgaagggggauggaccgguauggucgacggcugguacggguaucaucaccagaacgaacaaggaucaggcuacgccgcagaucucaaaaguacgcagaaugcuauugacgguaucaccaacaaggugaauagcguuauagagaaaaugaacacacaguuuacugccguggggaaggaguucaaucaccuggaaaagcggauugagaacuuaaauaaaaaggucgaugacggcuuccuggauaucuggaccuacaacgcugaacuccuugugcuguuggagaaugaacgcacacuagacuaucaugauuccaacguaaagaaccuguacgagaagguucgaucucagcucaaaaauaacgccaaggagaucggaaauggcuguuuugaguucuaucacaagugcgacaacacuuguauggaaagcgugaaaaaugggaccuacgauuauccaaaguacucagaagaggcaaaacugaacagagaagagauugacggagucaaacuugagaguacaaugaucuaucaaauucuggccauauacuccaccguggcuagcucuuugguccucgugguuucacugggugcgaucaguuuuuggaugugcagcaauggcuccuuacagugcaggauuuguaucuga

SEQ ID NO: 129054 - RNA, 1701 nt, Artificial Sequence; identical to SEQ ID NO: 129053
  derived and/or modified sequence opt3 from hemagglutinin__InfluenzaA__AEL89711

SEQ ID NO: 129055 - RNA, 1701 nt, Artificial Sequence; identical to SEQ ID NO: 128451
  derived and/or modified sequence opt3 from hemagglutinin__InfluenzaA__AEL89721

SEQ ID NO: 129056 - RNA, 1701 nt, Artificial Sequence
  derived and/or modified sequence opt3 from hemagglutinin__InfluenzaA__AEL89741
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuaccgccgaucaacagagcuuguaccagaacgcugacacauacguguucgucgggaccagucgcuauucuaagaaauuuaagccugagauugccauccgaccaaaagugcgugaucaggagggaagaaugaauuacuauuggacucugguggaacccggugacaagauuacauucgaggcgaccggcaaccuagucguuccuagguacgcauuugccauggaacggaacgcuggguccggaaucauaauuagcgauacgccagugcaugacugcaauacuacaugucaaaccccgaaaggcgccaucaacacuucgcuccccuuccagaauauucacccuaucacaaucgguaagugcccaaaguauguaaaaucuaccaagcugcgccuugcaacggggcugagaaacgugcccuccauucagucaaggggauuguuuggcgcuauagccggcuucaucgaagggggauggaccgguauggucgacggcugguacggguaucaucaccagaaugaacaaggaaguggcuacgcggccgaucucaaaagcacacagaacgcaauugacaagaucacuaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaaaccagcucaagaauaacgcuaaggagaucggcaauggauguuuugaguucuaucacaaaugcgacaacacauguauggaaagcgugaagaauggcaccuacgauuauccuaaauacucagaagaggccaagcugaacagagaagagauugacggggucaaacuugagaguacuaggaucuaucaaauucuggcaauauacuccacgguggccagcucuuugguccucgugguuucacugggagcuaucaguuuuuggaugugcagcaaugguuccuuacagugccggauuuguaucuga

SEQ ID NO: 129057 - RNA, 1701 nt, Artificial Sequence; identical to SEQ ID NO: 127600
  derived and/or modified sequence opt3 from hemagglutinin__InfluenzaA__AEL89751

SEQ ID NO: 129058 - RNA, 1701 nt, Artificial Sequence
  derived and/or modified sequence opt3 from hemagglutinin__InfluenzaA__AEL89761
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgguaucaccaauaaggugaacuccguuauagagaaaaugaauacacaguuuacugccguggggaaggaguucaaccaccuggaaaagcggauugagaauuuaaacaaaaaggucgaugacggcuuccuggauaucuggaccuacaaugcugaacuccuugugcuguuggagaacgaacgcacacuagacuaucaugauucuaauguaaagaaccuguacgagaagguucgaagccagcucaaaaacaaugccaaggagaucggaaacggcuguuuugaguucuaucacaagugcgacaauacuuguauggaaucagugaaaaacgggaccuacgauuauccaaaguacagugaagaggcaaaacugaauagagaagagauugacggagucaaacuugaguccacaaugaucuaucaaauucuggccauauacagcaccguggcuucuucauugguccucgugguuagucugggugcgaucagcuuuuggaugugcuccaacggcucuuuacagugcaggauuuguaucuga

SEQ ID NO: 129059 - RNA, 1701 nt, Artificial Sequence; identical to SEQ ID NO: 128936
  derived and/or modified sequence opt3 from hemagglutinin__InfluenzaA__AEL89771

SEQ ID NO: 129060 - RNA, 1701 nt, Artificial Sequence; identical to SEQ ID NO: 129058
  derived and/or modified sequence opt3 from hemagglutinin__InfluenzaA__AEL89781

SEQ ID NO: 129061 - RNA, 1701 nt, Artificial Sequence; identical to SEQ ID NO: 128451
  derived and/or modified sequence opt3 from hemagglutinin__InfluenzaA__AEL89791

SEQ ID NO: 129062 - RNA, 1701 nt, Artificial Sequence
  derived and/or modified sequence opt3 from hemagglutinin__InfluenzaA__AEL89801
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgaugcguacgucuucguggggaccagucgcuauucuaagaaauuuaagccugagauugcagugcgaccaaaaguccgugaccaggagggaagaaugaauuacuauuggacacugguugaacccggugauaagaucacuuucgaggccaccggcaaccuagugguaccuagguacgcuuuugccauggaacggaacgcaggguccggaauuaucauaagcgacacaccagugcaugauugcaauaccacgugucaaacuccgaaaggcgcuauuaacacaucgcuccccuuccagaauauccacccuauuaccaucgguaagugcccaaaguaugucaaaucuacuaagcugcgccuugccacagggcugagaaacgugcccuccauccagucaaggggauuguuuggcgcgauugccggcuucauagaagggggauggaccgguaugguugacggcugguacggguaucaucaccagaaugaacaaggaaguggcuacgcagcugaccucaaaagcacgcagaacgccaucgauaagauuaccaauaaagugaacuccgucaucgagaagaugaauacacaguuuacugcuguggguaaggaguucaaccaccuggaaaaacggauagagaauuuaaacaagaaaguagacgauggguuccuggacauuuggaccuacaaugccgaacuccuuguucuguuggagaacgaacgcacacuagauuaucaugacucuaaugugaagaaccuguacgagaaaguccgaaaccagcucaagaauaacgcaaaggagaucggcaauggauguuuugaguucuaucacaaaugcgauaacacuuguauggaaagcgugaagaauggcaccuacgacuauccuaaauacucagaagaggccaagcugaacagagaagagaucgauggggucaaacuugagaguacaaggauuuaucaaauccuggcuauuuacuccaccguggcgagcucuuugauacucguugugucacugggagcaaucaguuuuuggaugugcagcaaugguuccuuacagugccggauuuguaucuga

SEQ ID NO: 129063 - RNA, 1701 nt, Artificial Sequence
  derived and/or modified sequence opt3 from hemagglutinin__InfluenzaA__AEL89812
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaaugcaaccugucaaacgcccaaaggcguaaucaacacuucgcucccuuuccagaauauucacccaaucacaaucgguaagugccccaaguaugugaaaucuaccaagcugcgccuugcuacugggcugagaaacgucccuuccauucagucaaggggauuguuuggcgccauagcgggcuucaucgaagggggauggacagguaugguggacggcugguacggguaucaucaccagaaugaacaaggaaguggcuacgccgcagaucucaaaagcacccagaacgcuauugacgguaucacgaauaagguuaacuccgugauagagaaaaugaauacccaguuuacagccgucgggaaggaguucaaccaccuggaaaagcggauugagaauuuaaacaaaaagguggaugacggcuuccuggauaucuggacuuacaaugcugaacuccuuguacuguuggagaacgaacgcacccuagacuaucaugauucuaauguuaaaaaccuguacgagaaggugcgaagccagcucaaaaacaaugccaaggagaucggaaacggcuguuuugaguucuaucacaagugcgacaauacauguauggaaucagucaaaaacgggacuuacgauuauccaaaguacagugaagaggcaaaacugaauagagaagagauugacggagugaaacuugaguccaccaugaucuaucaaauucuggccauauacagcacagucgcuucuucauuggugcucguugugagucugggugcgaucagcuuuuggaugugcuccaacggcucuuuacagugcaggauuuguaucuga

SEQ ID NO: 129064 - RNA, 1701 nt, Artificial Sequence; identical to SEQ ID NO: 128451
  derived and/or modified sequence opt3 from hemagglutinin__InfluenzaA__AEL89832

SEQ ID NO: 129065 - RNA, 1701 nt, Artificial Sequence
  derived and/or modified sequence opt3 from hemagglutinin__InfluenzaA__AEL89842
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacgacgggaaacucuguaagcugagaggaguggcuccccuucaucuggguaaaugcaauauagccggcuggaucuuggggaacccugagugugaaucucucucaacagcaaguagcugguccuacauuguugagaccucuucgucagauaauggaacuugcuauccaggcgacuucaucgauuacgaggagcugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucuaaguccuauauaaacgauaagggcaaagaaguacuuguuuuguggggcauccaccaccccucaacgagcgcugaccaacagagucuguaccagaaugccgaugcguacguguuugucgggacuucucgcuauuccaagaaauucaagccugagauugcaauccgaccaaaagugcgugaccaggagggaagaaugaacuacuauuggacccuaguggaacccggugauaagauuacauuugaggccacuggcaaucucgucguuccuagguacgcuuucgccauggaacggaacgcagggagcggaaucauaauuucggacaccccagugcaugacugcaacgcuacaugucaaaccccgaaaggcgccaucaauacgucucugcccuuucagaacguacacccuauuacuaucgguaagugcccaaaguaugugaaauccacaaaacuucgccuggcgaccggguugagaaauguccccucaauccagaguaggggacucuucggcgccauugcaggcuuuauagaagggggauggacugguaugguggauggcugguacggguaucaucaccagaacgaacaaggaagcggcuacgcugccgaccugaaguccacacagaaugcuaucgauaagauuaccaacaaaguuaauucugugaucgagaagaugaacacgcaguucaccgccgucgguaaggaguuuaaucacuuagaaaaacggauagagaaccugaauaagaaaguggacgauggguuccucgacauuuggacauacaacgcagaacuucugguauugcuagagaaugaacgcacucuggauuaucaugacagcaacguuaagaaucucuacgagaaagugcgaucacagcugaagaacaacgccaaggagaucggcaauggauguuucgaauuuuaucacaaaugcgauaacaccuguauggagagugucaagaauggcacauacgacuauccuaaauacuccgaagaggcuaaacuuaacagagaagagaucgauggggugaagcuggagagcacuaggauuuaucaaaucuuggcgauuuacucuaccgucgcaucaagucucgugcugguugugagcuuaggagccauauccuucuggaugugcucuaaugguucgcugcagugccggaucuguauuuga

SEQ ID NO: 129066 - RNA, 1701 nt, Artificial Sequence
  derived and/or modified sequence opt3 from hemagglutinin__InfluenzaA__AEL89852
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaucaccagaacgaacaaggaagcggcuacgcagcugaccugaaguccacccagaaugccaucgauaaaauuacgaacaagguaaauucuguuaucgagaagaugaacacccaguuuacagcuguggguaaagaguucaaucacuuagaaaagaggauagagaaccugaauaaaaaggucgacgauggguuccucgacauuuggacuuacaacgccgaacuucugguguugcuagagaaugaacggacccuggauuaucaugacagcaacgugaaaaaccucuacgagaagguucgcucacagcugaagaauaacgcaaaagagaucggcaauggauguuuugaguucuaucacaagugcgauaacacauguauggaaagugugaaaaauggcacuuacgacuauccuaaguacuccgaagaggccaaacuuaaccgagaagagaucgauggggucaagcuggagagcaccagaauuuaucaaaucuuggcuauuuacucuacaguggcgucaagucucguccuggugguuagcuuaggagcaauauccuuuuggaugugcucuaaugguucgcugcagugcaggaucuguauuuga

SEQ ID NO: 129067 - RNA, 1701 nt, Artificial Sequence; identical to SEQ ID NO: 128470
  derived and/or modified sequence opt3 from hemagglutinin__InfluenzaA__AEL93568

SEQ ID NO: 129068 - RNA, 1701 nt, Artificial Sequence; identical to SEQ ID NO: 128451
  derived and/or modified sequence opt3 from hemagglutinin__InfluenzaA__AEL93578

SEQ ID NO: 129069 - RNA, 1701 nt, Artificial Sequence
  derived and/or modified sequence opt3 from hemagglutinin__InfluenzaA__AEL93598
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcguguuuaucgauuacgaggagcucagggagcagcugagcagugucuccucuuucgaacgguuugagauuuucccgaagacaagcuccuggcccaaucacgacucaaacaagggugugaccgccgcuuguccucaugcaggggccaaaaguuuuuauaagaaucugaucuggcucguuaaaaagggaaacagcuacccaaaauuaucuaaguccuauauaaaugauaagggcaaagaaguacuggugcuuuggggcauccaccaccccucaacgacugcugaccaacagagcuuguaccagaacgccgaugcguacgucuucguggggaccagucgcuauucuaagaaauuuaagccugagauugcaauccgaccaaaagugcgugaccaggagggaagaaugaauuacuauuggacacuggucgaacccggugauaagauuacuuucgaggccaccggcaaccuaguugugccuagguacgcuuuugccauggaacggaacgcaggguccggaaucauaauuagcgacacaccaguacaugauugcaauaccacgugucaaacuccgaaaggcgcuaucaacacaucgcuccccuuccagaauauucacccuaucaccaucgguaagugcccaaaguaugugaaaucuacuaagcugcgccuugccacagggcugagaaacguccccuccauucagucaaggggauuguuuggcgcgauagccggcuucaucgaagggggauggaccgguaugguggacggcugguacggguaucaucaccagaaugaacaaggaaguggcuacgcagcugaccucaaaagcacgcagaacgccauugauaagaucaccaauaaaguuaacuccgugauagagaagaugaauacacaguuuacugcugucgguaaggaguucaaccaccuggaaaaacggauugagaauuuaaacaagaaaguggacgauggguuccuggacaucuggaccuacaaugccgaacuccuuguacuguuggagaacgaacgcacacuagauuaucaugacucuaauguuaagaaccuguacgagaaagugcgaaaccagcucaagaauaacgcaaaggagaucggcaauggauguuuugaguucuaucacaaaugcgauaacacuuguauggaaagcgucaagaauggcaccuacgacuauccuaaauacucagaagaggccaagcugaacagagaagagauugauggggugaaacuugagaguacaaggaucuaucaaauucuggcuauauacuccaccgucgcgagcucuuuggugcucguugugucacugggagcaaucaguuuuuggaugugcagcaaugguuccuuacagugccggauuuguaucuga

SEQ ID NO: 129070 - RNA, 1701 nt, Artificial Sequence
  derived and/or modified sequence opt3 from hemagglutinin__InfluenzaA__AEL93618
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgacugcugaucaacagagccuuuaccagaacgccgacaccuacguguucgucgggacaagucgcuauucuaagaaauuuaagccugagauugcgauccgaccaaaagugcgugaucaggagggaagaaugaauuacuauuggacuuugguggaacccggugacaagauuaccuucgaggcaacaggcaaccuggucguuccuagguacgccuuugcuauggaacggaacgccggguccggaaucauaauuagcgauaccccagugcaugacugcaauacgacuugucaaacaccgaaaggcgcaaucaacaccucgcuacccuuccagaauauucacccuaucacuaucgguaagugcccaaaguauguaaaaucuacaaagcuccgccuggcuaccgggcuuagaaacgugcccuccauucagucaaggggacuguuuggcgccauagcgggcuucaucgaagggggauggacggguauggucgacggcugguacggguaucaucaccagaaugaacaaggaaguggcuacgccgcagauuugaaaagcacccagaacgcuauugacaagaucacaaauaaagugaacuccguuauagagaagaugaauacucaguuuaccgccguggguaaggaguucaaccaccucgaaaaacggauugagaaucugaacaagaaagucgaugacggguucuuagauaucuggacauacaaugcugaacugcucgugcuucuggagaacgaacgcacuuuggacuaucaugauucuaauguaaagaaccuauacgagaaaguucgaaaccagcugaagaauaacgccaaggagaucggcaauggauguuuugaguucuaucacaaaugcgacaacaccuguauggagagcgugaagaauggcacauacgauuauccuaaauacucagaagaggcaaagcucaacagagaagagauugacggggucaaacuggagaguaccaggaucuaucaaauucuugccauauacuccacuguggcuagcucucuggucuuggugguuucacucggagcgaucaguuuuuggaugugcagcaaugguucccugcagugccggauuuguaucuga

SEQ ID NO: 129071 - RNA, 1701 nt, Artificial Sequence; identical to SEQ ID NO: 128451
  derived and/or modified sequence opt3 from hemagglutinin__InfluenzaA__AEL93628

SEQ ID NO: 129072 - RNA, 1701 nt, Artificial Sequence; identical to SEQ ID NO: 128886
  derived and/or modified sequence opt3 from hemagglutinin__InfluenzaA__AEL93638

SEQ ID NO: 129073 - RNA, 1701 nt, Artificial Sequence
  derived and/or modified sequence opt3 from hemagglutinin__InfluenzaA__AEL94870
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagcucaugacugcaacacaaccugucaaacgccgaaaggcgccaucaauacuucucuccccuuccagaacauucacccuaucacaaucgguaagugcccaaaguaugugaaauccaccaagcugcgccuugcgacugggcugagaaauguacccucaauucagaguaggggauuguuuggcgccauagcaggcuucaucgaagggggauggacagguaugguggauggcugguacggguaucaucaccagaacgaacaaggaagcggcuacgcugccgaccucaaauccacccagaaugcuauugauaagaucacgaacaaagucaauucugugauaaagaagaugaacacccaguuuacagccguugguaaagaguucaaucaccuggagaagcggauugaaaacuuaaauaaaaagguggacgauggguuccuggacaucuggacuuacaacgcagagcuccuuguccuguuggaaaaugagcgcacccuagauuaucaugacagcaacgugaaaaaucuguacgaaaagguacgaucacagcucaagaacaacgccaaagagaucggcaauggauguuuugaguucuaucacaagugcgauaacacauguauggaaaguguuaaaaauggcacuuacgacuauccuaaguacuccgaggaagcuaaacugaacagagaggaaauugauggggugaaacuugagagcaccaggaucuaucaaauucuggcgauauacucuacagucgcaucaaguuuggugcucgucgugagccugggagccaucuccuuuuggaugugcucuaaugguucguuacagugccggauuuguaucuga

SEQ ID NO: 129074 - RNA, 1701 nt, Artificial Sequence
  derived and/or modified sequence opt3 from hemagglutinin__InfluenzaA__AEL95426
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgacucgaccaaaagugcgugaucaggagggaagaaugaauuacuauuggacccugguggaacccggugacaagaucacauucgaggcaaccggcaaccuagucguuccuagguacgccuuugcuauggaacggaacgccggguccggaauuaucauaagcgauacgccagugcaugacugcaauacuacaugucaaaccccgaaaggcgcaauuaacacuucgcuccccuuccagaauauccacccuauuacaaucgguaagugcccaaaguauguaaaaucuaccaagcugcgccuugcuacggggcugagaaacgugcccuccauccagucaaggggauuguuuggcgccauugcgggcuucauagaagggggauggaccgguauggucgacggcugguacggguaucaucaccagaaugaacaaggaaguggcuacgccgcagaucucaaaagcacacagaacgcuaucgacaagauuacuaauaaagugaacuccguuaucgagaagaugaauacccaguuuacagccguggguaaggaguucaaccaccuggaaaaacggauagagaauuuaaacaagaaagucgaugacggguuccuggauauuuggacuuacaaugcugaacuccuugugcuguuggagaacgaacgcacccuagacuaucaugauucuaauguaaagaaccuguacgagaaaguucgaaaccagcucaagaauaacgccaaggagaucggcaauggauguuuugaguucuaucacaaaugcgacaacacauguauggaaagcgugaagaauggcaccuacgauuauccuaaauacucagaagaggcaaagcugaacagagaagagaucgacggggucaaacuugagaguacuaggauuuaucaaauccuggccauuuacuccacgguggcuagcucuuugguccucgugguuucacugggagcgauaaguuuuuggaugugcagcaaugguuccuuacagugccggaucuguauuuga

SEQ ID NO: 129075 - RNA, 1701 nt, Artificial Sequence
  derived and/or modified sequence opt3 from hemagglutinin__InfluenzaA__AEL97631
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucaagcgguuugaaaucuucccgaagacaagcuccuggcccaaucacgauucaaacaaaggugucaccgccgcuuguccucaugcaggggccaagaguuuuuauaaaaaucugauauggcuggugaagaaaggaaacagcuacccaaagcucucuaaguccuauaucaaugacaaaggcaaggagguauuaguucuguggggcauucaccaccccucaacgagcgcugaucaacagagucuuuaccagaacgccgacgcguacguguucgucgggacuucucgcuauuccaaaaaguuuaaaccugaaaucgcaauucgaccaaaggugcgugaucaggagggaagaaugaauuacuauuggaccuugguggagcccggugacaaaaucacauucgaagccacuggcaaccuggucguuccuagguacgcuuuugccauggagcggaacgcagggagcggaauaauuaucucggauaccccagugcaugacugcaauacaaccugucaaacgccgaagggcgcuauuaacacuucucuacccuuccagaauauccacccuacaaccaucgguaagugcccaaaauauguaaaguccacuaaacuccgccuggccacagggcuuagaaacgugcccucaauucagaguaggggacuguuuggcgcgauagccggcuucaucgaagggggauggaccgguauggucgacggcugguacggguaucaucaccagaaugagcaaggaagcggcuacgcagcugauuugaaguccacgcagaacgccauugacgaaaucaccaauaaagugaacucuguuauagagaagaugaauacacaguuuacugcuguggguaaggaguucaaccaccucgaaaaacggauugagaaucugaacaagaaagucgaugacggguucuuagauaucuggaccuacaaugccgaacugcucgugcuucuggagaacgaacgcacauuggacuaucaugauagcaauguaaagaaccuauacgagaaaguucgaucacagcugaagaacaaugcaaaggagaucggcaacggauguuuugaguucuaucacaaaugcgacaauacuuguauggaaagugugaagaacggcaccuacgauuauccuaaauacuccgaagaggccaagcucaauagagaagagauugacggggucaaacuggagagcacaaggaucuaucaaauucuugcuauauacucuaccguggcgucaagucuggucuuggugguuagccucggagcaaucuccuuuuggaugugcucuaacgguucgcugcagugccggauuuguaucuga

SEQ ID NO: 129076 - RNA, 1701 nt, Artificial Sequence
  derived and/or modified sequence opt3 from hemagglutinin__InfluenzaA__AEL99664
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucaagcgguuugaaaucuucccgaagacaagcuccuggcccaaucacgauucaaacaaaggugugaccgccgcuuguccucaugcaggggccaagaguuuuuauaaaaaucugauauggcucgucaagaaaggaaacagcuacccaaaguuaucuaaguccuauaucaaugacaaaggcaaggaggugcugguacuuuggggcauucaccaccccucaacgagcgcugaucaacagaguuuguaccagaacgccgacgcguacguuuucguggggacuucucgcuauuccaaaaaguuuaaaccugaaaucgcaauucgaccaaagguccgugaucaggagggaagaaugaauuacuauuggacccugguggagcccggugacaaaaucacauucgaagccacuggcaaccuaguggucccuagguacgcuuuugccauggagcggaacgcagggagcggaauaauuaucucggauaccucuguucaugacugcaauacaaccugucaaacgccaaagggcgcuauuaacacuucccucccguuccagaauauccaccccaucacaauugguaagugcccuaaauaugugaagucaaccaaacugcgccuugccacugggcugagaaacguaccaaguauacagagcaggggauuguuuggcgcgaucgccggcuucauugaagggggauggacagguaugguggacggcugguacggguaucaucaccagaaugagcaaggauccggcuacgcagcugaucucaagucuacccagaacgccaucgacgaaauaacgaauaaagucaacagcgugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauucaaaugugaagaaccuguacgagaaaguacgaagucagcucaagaacaaugcaaaggagauuggcaacggauguuuugaguucuaucacaaaugcgacaauacauguauggaguccguuaagaacggcacuuacgauuaucccaaauacagcgaagaggccaagcugaauagagaagagaucgacggggugaaacuugagucuaccaggauuuaucaaauacuggcuaucuacucaacagucgcgaguagcuuggugcucgucgugucccugggagcaauuucuuuuuggaugugcucgaacgguagcuuacagugccggaucuguaucuga

SEQ ID NO: 129077 - RNA, 1701 nt, Artificial Sequence
  derived and/or modified sequence opt3 from hemagglutinin__InfluenzaA__AEL99674
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuaucuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 129078 - RNA, 1689 nt, Artificial Sequence; identical to SEQ ID NO: 128287
  derived and/or modified sequence opt3 from hemagglutinin__InfluenzaA__AEM53455

SEQ ID NO: 129079 - RNA, 1689 nt, Artificial Sequence; identical to SEQ ID NO: 123636
  derived and/or modified sequence opt3 from hemagglutinin__InfluenzaA__AEM53468

SEQ ID NO: 129080 - RNA, 1698 nt, Artificial Sequence; identical to SEQ ID NO: 124131
  derived and/or modified sequence opt3 from hemagglutinin__InfluenzaA__AEM60037

SEQ ID NO: 129081 - RNA, 1698 nt, Artificial Sequence
  derived and/or modified sequence opt3 from hemagglutinin__InfluenzaA__AEM60058
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagagucucacaacgggaaacuaugccuccugaagggaauagcgccccuucagcuggguaauuguucaguggccggcuggaucuuggggaacccugaaugcgagcuccugauuaguaaagaaagcugguccuacaucguugagaccccaaauccggagaacggaacuuguuaucccggcuacuuugcugauuaugaagaacugagagaacaacucucuucggugagcucauucgagagguuugagauuuucccuaaggaaaguuccuggccaaaucauacagucaccggugugucugccagcugcucccacaacggggagucaaguuuuuaccggaauuuacuguggcuuacgggaaagaacggcuuguaucccaaucugagcaaaucuuacgcaaacaauaaggaaaaagacguucuaguacucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccaggugauacuauuaucuuugaagccaacggcaauuugauugcuccgcgcuucgccuuugcgcucgggagaggauucggcucugguaucauaaccuccaacgcacccauggacaagugugaugccaagugccagacaccucaaggggcuauuaauagcucgcugccauuucagaacguucaccccgugaccaucggagaguguccuaaauauguaaggucuacgaaguuacggauggugacuggccugcgcaauauuccauccauccagucacgaggccucuucggggccaucgcaggauuuauugaagguggcuggacagggauggucgacggaugguacggcuaucaucaccagaacgagcaagguaguggguacgcugccgaucagaaaagcacccagaaugcgauaaacggcaucacuaauaaggugaacuccguuauugagaaaaugaauacacaguucaccgccgugggaaaggaguucaacaaacuugagagaaggauggaaaaucugaacaagaaggucgacgauggcuuuuuggacaucuggacguacaacgcagagcuacuggugcuccuggaaaaugagcggacccuugacuuccacgauucuaacguuaaaaaucuguaugaaaagguaaaaagccaauugaagaacaaugcuaaagagauagggaacggaugcuuugaguucuaccauaaguguaaugacgaaugcauggagucagugaagaacgguacauaugauuaccccaaauauagugaagaguccaagcucaaucgugagaaaauugacggcgucaagcuggaaagcauggggguguaccagaucuuagccaucuauucuacugucgcuucaagucuggugcuacucguuagccugggagccauuuccuuuuggaugugcucuaacggcucgcuucagugucgcaucugcauuuga

SEQ ID NO: 129082 - RNA, 1701 nt, Artificial Sequence
  derived and/or modified sequence opt3 from hemagglutinin__InfluenzaA__AEM60069
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaaguccuucuuuucacgucugaacuggcuccacgagagugaguacaaauauccagcauuaaaugucacgaugcccaacaauggcaaguucgauaaacuguacaucuggggagugcaucacccuagcacugacagagaacaaaccaaccuuuacguaagggccucugggcggguuacaguguccacuaagcgcucacagcagaccgucauuccaaauaucgguagcagacccugggugaggggcuugaguucucggauuuccaucuauuggacaauagugaaaccuggggauauucugcuaaucaacagcaccggaaaccucauugcuccacgcggcuacuuuaagauccgaacggguaagucgucuaucaugagauccgacgccccgauugggacuuguucaagugagugcauaacacccaauggaagcaucccuaacgacaaaccauuccagaaugucaacaagauuaccuauggcgcgugucccagguacguuaaacaaaauacucugaaacuugcaacaggcaugcggaacgugccugaaaagcagacccgugggaucuuuggagccauagcugguuucauugagaauggcugggaggggaugguagauggaugguauggcuuucgccaccagaacuccgaagguacggggcaggccgcagaccugaagucuacccaagcugccaucgaucagaucaauggcaaauugaacagacucauugagaagacaaaugaaaaguuccaucagaucgagaaagaguucagcgaaguggagggaaggauucaagaccuggaaaaguacgucgaggauacuaaaauagacuuauggucauauaacgcggaacugcucguggcccuugagaaucagcacaccaucgaucugacagacagugaaaugaacaaguuguuugagaaaacucggaagcagcuacgagagaaugcagaagauaugggcaacgggugcuucaagauuuaccauaaaugugacaacgcuugcaucggauccauccgcaaugguaccuacgaucacgacguuuauagagacgaggcccugaacaauagguuucagauuaagggcguggaacucaaaagcggguacaaggauuggauacuguggaucucuuucgcuauuucaugcuuucuucugugugucguguugcucggauucaucaugugggccugccaaaaaggcaacauucgguguaauaucugcauauga

SEQ ID NO: 129083 - RNA, 1701 nt, Artificial Sequence
  derived and/or modified sequence opt3 from hemagglutinin__InfluenzaA__AEM92308
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagcgcaacagcuacccaaaauuaucuaaguccuauauaaaugacaagggaaaagaaguacugguucuuuggggcauccaccaccccucaacgagcgcugaucaacagaguuuguaccagaacgccgacgcguacguguucgucgggucuucccgauauagcaagaaauuuaagccugagauugcaauccguccaaaagugagagaucaggagggcaggaugaauuacuauuggacucugguggaacccggagacaagauuaccuucgaggccacagaaaaccuagucguuccucgguacgcuuuugccauggagcgcaacgcagguucgggcaucauaauuucugauacuccagugcaugacugcaauaccacaugucaaaccccgaaaggggcuaucaacacgucccuccccuuccagaauauucacccuaucacuaucggaaagugcccaaaguauguaaaaucaacaaagcugagacuugccaccggccugaggaacgugcccaguauucagagccgggguuuguuuggggcgauagccggauucaucgaaggcggcuggacugggauggucgacggaugguacgguuaucaucaccagaaugagcaaggcuccggguacgcagcugaucucaaaucuacacagaacgccauugacgagaucaccaauaaggugaacagcguuauagaaaagaugaauacgcaguuuaccgcugugggaaaggaguucaaccaccuggaaaagcgcauugagaauuuaaacaaaaaggucgaugacggcuuccuggauaucuggacauacaaugccgaacuccuugugcuguuggagaacgagcgaacucuagacuaucaugauucaaauguuaaaaaccuguacgaaaagguaagaagucagcucaaaaacaaugcaaaggagguggguaacggguguuuugaguucuaucacaagugcgacaauaccuguauggaguccgucaaaaacggcacauacgauuauccuaaguacagcgaagaggccaaacugaauagggaggaaaucgacggagugaaacuugagucuacucggauuuaucaaauccuggcuauuuacucaaccgcggcaaguagcuugguccucgugguuucccugggcgccauaucuuuuuggaugugcucgaacgggagcuuacagugccguaucuguauuuga

SEQ ID NO: 129084 - RNA, 1701 nt, Artificial Sequence
  derived and/or modified sequence opt3 from hemagglutinin__InfluenzaA__AEM92318
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggaaaagaguuuuuauaagaaccugaucuggcucgugaaaaagggaaauagcuacccaaaauuaaacaagucuuauauaaaugauaagggcaaagagguacugguucuuuggggcauccaccaccccuccacgucagccgaccaacagagcuuguaccagaacgcugaugccuacguguucgucgggaccagucgcuauucuaagaaauuuaagccugagauugcgauccgaccaaaagugcgugaccaggaaggaagaaugaauuacuauuggacucugguggagcccggugauaagauuacauucgaagcaacuggcaaccuagucguuccuagguacgccuuugcuauggagcggaacgccggguccggaaucauaauuagcgacaccccaauccaugacugcaauacaaccugucaaacgccgaaaggcgcaauuaacacuucgcuccccuuccagaauauccacccuaucacaauugguaagugcccaaaguaugugaaaucuaccaagcugcgccuugcuacugggcugagaaacguacccuccauacagucaaggggauuguuuggcgccaucgcgggcuucauugaagggggauggacagguaugguggauggcugguacggguaucaucaccagaaugagcaaggaaguggcuacgccgcagaccucaaaagcacccagaacgcuaucgaugagauaacgaauaaggucaacuccgugauugagaaaaugaauacccaguuuacagccguugguaaggaguucaaccaccuggaaaagcggaucgagaauuuaaacaaaaagguggacgauggguuccuggacaucuggacuuacaaugcugaacuccuuguccuguuggagaacgagcgcacccuagauuaucaugacucuaaugugaaaaaccuguacgaaaagguacgaaaccagcucaaaaauaacgccaaggagauuggcaauggauguuuugaguucuaucacaagugcgauaacacauguauggaaagcguuaaaaauggcacuuacgacuauccuaaguacucagaagaggcaaaacugaacagagaggaaaucgauggggugaaacuugagaguaccaggauuuaucaaauacuggccaucuacuccacagucgcuagcucuuuggugcucgucgugucacugggagcgauuaguuuuuggaugugcagcaaugguuccuuacagugccggaucuguaucuga

SEQ ID NO: 129085 - RNA, 1701 nt, Artificial Sequence
  derived and/or modified sequence opt3 from hemagglutinin__InfluenzaA__AEM92328
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauauaucuuauaucaacgacaagggcaaggaaguacugguucuuuggggcauucaccaccccuccacgacugcugaucaacagucauuguaccagaaugccgacgcguacguguucgucgggaccagccgcuauaguaaaaaguuuaaaccugagaucgcaauucgaccaaaggugcgugaucaggagggaagaaugaacuacuauuggacacugguggaacccggugacaaaaucacuuucgaggccaccggcaaccuagucguuccuagguacgcuuuugccauggaacggaaugcagggucuggaauaauuaucuccgauacaccagugcaugacugcaacaccacgugucaaacuccgaagggcgcuauuaauacaagccuccccuuccagaacauccacccuaucaccauugguaaaugcccaaaguauguaaagucgacuaaacugcgccuugccacagggcugagaaaugugcccucuauacaguccaggggauuguuuggcgcgaucgccggcuucauugaagggggauggaccgguauggucgacggcugguacggguaucaucaccagaacgaacaaggaucaggcuacgcagcugaucucaagaguacgcagaaugccaucgacaaaauaaccaacaaggugaauagcguuauugagaaaaugaacacacaguuuacugcuguggguaaggaguucaaucaccuggaaaagcggaucgagaacuuaaauaaaaaggucgaugacggguuccuggauaucuggaccuacaacgccgaacuccuugugcuguuggagaaugaacgcacacuagacuaucaugauuccaacguaaagaaccuguacgagaagguucgaaaucagcucaaaaacaaugcaaaggagauuggcaacggauguuuugaguucuaucacaagugcgacaauacuuguauggaaucugugaaaaacggcaccuacgauuauccuaaguacagcgaagaggccaaacugaauagagaagagaucgacggggucaaacuugagucaacaaggauuuaucaaauacuggcuaucuacaguaccguggcguccagcuugguccucgugguuucucugggagcaauuucauuuuggaugugcaguaacgguagcuuacagugccggaucuguaucuga

SEQ ID NO: 129086 - RNA, 1701 nt, Artificial Sequence
  derived and/or modified sequence opt3 from hemagglutinin__InfluenzaA__AEM92348
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggaaaagaguuuuuauaagaaccugaucuggcucgugaaaaagggaaauagcuacccaaaauuaaacaagucuuauauaaaugauaagggcaaagagguacugguucuuuggggcauccaccaccccuccacgucagccgaccaacagagcuuguaccagaacgcugaugccuacguguucgucgggaccagucgcuauucuaagaaauuuaagccugagauugcgauccgaccaaaagugcgugaccaggaaggaagaaugaauuacuauuggacucugguggagcccggugauaagauuacauucgaagcaacuggcaaccuagucguuccuagguacgccuuugcuauggagcggaacgccggguccggaaucauaauuagcgacaccccaauccaugacugcaauacaaccugucaaacgccgaaaggcgcaauuaacacuucgcuccccuuccagaauauccacccuaucacaauugguaagugcccaaaguaugugaaaucuaccaagcugcgccuugcuacugggcugagaaacguacccuccauacagucaaggggauuguuuggcgccaucgcgggcuucauugaagggggauggacagguaugguggauggcugguacggguaucaucaccagaaugagcaaggaaguggcuacgccgcagaccucaaaagcacccagaacgcuaucgaugagauaacgaauaaggucaacuccgugauugagaaaaugaauacccaguuuacagccguugguaaggaguucaaccaccuggaaaagcggaucgagaauuuaaacaaaaagguggacgauggguuccuggacaucuggacuuacaaugcugaacuccuuguccuguuggagaacgagcgcacccuagauuaucaugacucuaaugugaaaaaccuguacgaaaagguaaaaagccagcucaagaacaaugccaaggagauuggcaacggauguuuugaguucuaucacaaaugcgauaauacauguauggaaucaguuaagaacggcacuuacgacuauccuaaauacagugaagaggcaaagcugaaucgagagaaaaucgauggggugaaacuugaauccaccagaauuuaucaaauacuggccaucuacagcacagucgcuucuucauuggugcucgucgugagucugggagcgauuagcuuuuggaugugcuccaacgguucuuuacagugcaggaucuguaucuga

SEQ ID NO: 129087 - RNA, 1701 nt, Artificial Sequence
  derived and/or modified sequence opt3 from hemagglutinin__InfluenzaA__AEM92358
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaagaaggaaauagcuacccaaaguuaucuaaauccuauauaaacgauaagggcaaggagguacugguucuuuggggcauccaccaccccucaacgacuaccgaccaacagagcuuguaccagaaugcugaugccuacguguucgucgggacaagucgcuauucuaaaaaguuuaaaccugagauugcgauccgaccaaagaugcgugaccaggaaggaagaaugaacuacuauuggacucugguggagcccggugauaaaauuaccuucgaagcaacaggcaaccuaguggucccuagguacgccuuugcuauggagcggaaugccggguccggaaucauaauuagcgacaccccaguucaugauugcaacacgacuugucaaacaccgaagggcgcaaucaauaccucgcuccccuuccagaacauucacccuaucacuaucgguaaaugcccaaaguaugugaagucuacaaaacugcgccuugcuaccgggcugagaaauguacccuccauucagucaaggggauuguuuggcgccauagcgggcuucaucgaagggggauggacggguaugguggacggcugguacggguaucaucaccagaacgagcaaggaaguggcuacgccgcagaccucaagagcacccagaaugcuauugauaaaaucacaaacaaggucaauuccgugauagagaaaaugaacacucaguuuaccgccguugguaaggaguucaaucaccuggagaagcggauugaaaacuuaaauaaaaagguggacgauggguuccuggacaucuggacauacaacgcugagcuccuuguccuguuggaaaaugagcgcacucuagauuaucaugacucuaacgugaaaaaccuguacgagaagguacgaaaucagcucaaaaacaaugccaaggaaaucggcaacggauguuuugaguucuaucacaagugcgauaauaccuguauggaaagcguuaaaaacggcacauacgacuauccuaaguacucagaggaagcaaaacugaauagagaggagauugauggggugaaacuugaaaguaccaggaucuaucaaauucuggccauauacuccacugucgcuagcucuuuggugcucgucgugucacugggagcgaucaguuuuuggaugugcagcaacgguuccuuacagugccggauuuguaucuga

SEQ ID NO: 129088 - RNA, 1701 nt, Artificial Sequence
  derived and/or modified sequence opt3 from hemagglutinin__InfluenzaA__AEM92368
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgacugcugaucaacagucauuguaccagaaugccgacgcguacguguucgucgggaccagccgcuauaguaagaaauuuaagccugagauugcaauccgaccaaaagugcgugaucaggagggaagaaugaacuacuauuggacacugguggaacccggugacaagauuacuuucgaggccaccggcaaccuagucguuccuagguacgcuuuugccauggaacggaaugcagggucuggaaucauaauuuccgauacaccagugcaugacugcaacaccacgugucaaacuccgaaaggcgcuaucaauacaagccuccccuuccagaacauucacccuaucaccaucgguaagugcccaaaguauguaaaaucgacuaagcugcgccuugccacagggcugagaaaugugcccucuauucaguccaggggauuguuuggcgcgauagccggcuucaucgaagggggauggaccgguauggucgacggcugguacggguaucaucaccagaacgaacaaggaucaggcuacgcagcugaucucaaaaguacgcagaaugccauugacaagaucaccaacaaagugaauagcguuauagagaagaugaacacacaguuuacugcuguggguaaggaguucaaucaccuggaaaaacggauugagaacuuaaauaagaaagucgaugacggguuccuggauaucuggaccuacaacgccgaacuccuugugcuguuggagaaugaacgcacacuagacuaucaugauuccaacguaaagaaccuguacgagaaaguucgaaaucagcucaagaacaaugcaaaggagaucggcaacggauguuuugaguucuaucacaaaugcgacaauacuuguauggaaucugugaagaacggcaccuacgauuauccuaaauacagcgaagaggccaagcugaauagagaagagauugacggggucaaacuugagucaacaaggaucuaucaaauucuggcuauauacaguaccguggcguccagcuugguccucgugguuucucugggagcaaucucauuuuggaugugcaguaacgguagcuuacagugccggauuuguaucuga

SEQ ID NO: 129089 - RNA, 1701 nt, Artificial Sequence
  derived and/or modified sequence opt3 from hemagglutinin__InfluenzaA__AEM92378
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugaauagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaaacaagagcuauauaaaugacaagggcaaagaaguacugguucuuuggggcauccaccaccccucuacgacugcugaucaacaguccuuguaccagaacgccgacgcguacguguucgucgggaccucacgcuauagcaagaaauuuaagccugagauugcaauccgaccaaaagugcgugaucaggagggaagaaugaacuacuauuggacacugguggaacccggugacaagauuacuuucgaggccaccggcaaucuagucguuccuagguacgcuuuugccauggaacggaacgcagggaguggaaucauaauuucugauacaccagugcaugacugcaauaccacgugucaaacuccgaaaggcgcuaucaacacaucccuccccuuccagaauauucacccuaucaccaucgguaagugcccaaaguauguaaaaagcacuaagcugcgccuugccacagggcugagaaacgugcccucgauucagucuaggggauuguuuggcgcgauagccggcuucaucgaagggggauggaccgguauggucgacggcugguacggguaucaucaccagaaugaacaaggauccggcuacgcagcugaucucaaaucaacgcagaacgccauugacaagaucaccaauaaagugaacaguguuauagagaagaugaauacacaguuuacugcuguggguaaggaguucaaccaccuggaaaaacggauugagaauuuaaacaagaaagucgaugacggguuccuggauaucuggaccuacaaugccgaacuccuugugcuguuggagaacgaacgcacacuagacuaucaugauagcaacguaaagaaucuguacgagaaaguucgaaaccagcucaagaauaacgcaaaggagaucggcaauggauguuuugaguucuaucacaaaugcgacaacacuuguauggaauccgugaagaauggcaccuacgauuauccuaaauacucugaagaggccaagcugaacagagaagagauugacggggucaaacuugagagcacaaggaucuaucaaauucuggcuauauacucaaccguggcgaguuccuugguccucgugguuagccugggagcaaucucuuuuuggaugugcucaaaugguaguuuacagugccggauuuguaucuga

SEQ ID NO: 129090 - RNA, 1701 nt, Artificial Sequence
  derived and/or modified sequence opt3 from hemagglutinin__InfluenzaA__AEM92407
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaaacucuuggcccaaucacgauagcaacaagggugucaccgccgcuuguccucaugcaggggccaaauccuuuuauaagaaucugaucuggcucgugaaaaagggaaacucauacccaaaauuaaguaagagcuauauaaaugacaagggcaaagaaguacugguucuuuggggcauccaccaccccucuacguccacugaucaacagucauuguaccagaacgcugacgccuacguguucgucgggaccagccgcuauaguaagaaauuuaagccugagauugcgauccgaccaaaagugcguaaccaggagggaagaaugaauuacuauuggacacugguggaacccggugauaagauuacuuucgaggcaaccggcaaccuagucguuccuagguacgccuuuacaaucgaacggaaugcugggucuggaauaauuaucuccgacaccccaauucaugauugcaacacgacuugucaaacaccgaaaggcgccaucaauaccagccuccccuuccagaacauccacccuauuacuauagguaagugcccaaaguaugugaaaucgacaaagcugcgccuugcaaccgggcugagaaauguacccucuauccaguccaggggauuguuuggcgcuauugccggcuucaucgaagggggauggacggguaugguggacggcugguacggguaucaucaccagaacgaacaaggaucaggcuacgcggccgaccucaaaaguacccagaaugcaauagaugagauuacaaacaaggucaauagcgugaucgagaaaaugaacacucaguuuaccgcuguugguaaggaguucaaucaccuggaaaagcggaucgaaaacuuaaauaaaaagguggacgauggguuccuggacauuuggacacauaacgccgagcuccuuguccuguuggaaaacgagcgcacucuagauuaccacgacuccaaugugaaaaaccuguaugagaagguacgaucucagcucaaaaauaacgcuaaggaaaucggcaauggauguuuugaguucuaccauaagugcgauaacaccuguauggaaagcguuaaaaauggcacauaugacuacccuaaguauucagaggaagccaaacugaacagagaggagauugauggggugaaacuugaaaguaccaggauauaccaaauccuggcaauuuauuccacugucgccagcucuuuggugcucgucgugucacugggagcuaucaguuuuuggaugugcagcauggguuccuuacagugccggaucuguauuuga

SEQ ID NO: 129091 - RNA, 1701 nt, Artificial Sequence
  derived and/or modified sequence opt3 from hemagglutinin__InfluenzaA__AEM92417
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaaggccagcuccuggcccaaucacgauucaaacaagggugucacagcugcauguccucaugccggggcuaaaaguuuuuauaagaaucugauauggcuggugaaaaaggaaaacagcuacccaaaacucucuaaguccuauaucaaugacaagggaaaagagguauuaguucuguggggcauucaccaccccucaaccagcgccgaucaacagagucuuuaccagaacgcggacgcauacguguucgucgggucuucccgcuauagcaagaaauuuaagccugagaucgccauucgaccaaaagugcgugaucaggaaggcagaaugaauuacuauuggacguugguggagcccggagacaagaucacuuucgaagcuaccgguaaccuggucguuccuagguacgccuuugcaauggagcggaacgcuggcucggggauaauuaucucugauacaccagugcaugacugcaauacuaccugucaaacaccgaaaggagccauuaacaccucccuacccuuccagaauauccacccuaucacgauuggcaagugcccaaaguauguaaaaucaacuaagcuccgccuggcgacaggucuuagaaacgugcccaguauacagagcagggggcuguuuggagccaucgcaggcuucauugaaggcggguggaccggaauggucgacgguugguacggcuaucaucaccagaaugagcaaggguccggauacgcugccgauuugaaaucuacucagaacgcuaucgacgagauaacaaauaaggugaacagcguuauugaaaagaugaauacccaguuuacggccgugggcaaagaguucaaccaccucgaaaagcggaucgagaaucugaacaaaaaggucgaugacgguuucuuagauaucuggaccuacaaugcagaacugcucgugcuucuggagaacgagcgcacauuggacuaucaugauucaaauguuaaaaaccuauacgaaaagguacgaagucagcugaaaaacaaugccaaggagauugggaacggcuguuuugaguucuaucacaagugcgacaauacuuguauggaauccgugaaaaacggaaccuacgauuauccuaaguacagcgaagaggcuaaacucaauagagaggaaaucgacggcgucaagcuggagucuacaaggauuuaucaaauacuugcgaucuacucaacuguggcaaguagccuggucuuggugguuucccucggggccauuucuuuuuggaugugcucgaacggaagccugcagugccggaucuguaucuga

SEQ ID NO: 129092 - RNA, 1701 nt, Artificial Sequence
  derived and/or modified sequence opt3 from hemagglutinin__InfluenzaA__AEM92428
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauauguguauggaaagugugaaaaacggcacauacgauuauccuaaguacuccgaggaagccaaacugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 129093 - RNA, 1701 nt, Artificial Sequence
  derived and/or modified sequence opt3 from hemagglutinin__InfluenzaA__AEM92438
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaauccgaaaccagcucaagaauaacgccaaggagauuggaaauggcuguuuugaguucuaucacaaaugcgacaacaccuguauggagucuguuaagaaugggacauacgauuauccuaaauacagcgaagaggcaaagcugaacagagaagagaucgacggagugaaacuugagucaaccaggauuuaucaaauacuggccaucuacaguacugucgcuuccagcuuggugcucgucgugucucugggugcgauuucauuuuggaugugcaguaauggcagcuuacagugccggaucuguaucuga

SEQ ID NO: 129094 - RNA, 1701 nt, Artificial Sequence; identical to SEQ ID NO: 128825
  derived and/or modified sequence opt3 from hemagglutinin__InfluenzaA__AEM92448

SEQ ID NO: 129095 - RNA, 1701 nt, Artificial Sequence; identical to SEQ ID NO: 128825
  derived and/or modified sequence opt3 from hemagglutinin__InfluenzaA__AEM92458

SEQ ID NO: 129096 - RNA, 1701 nt, Artificial Sequence
  derived and/or modified sequence opt3 from hemagglutinin__InfluenzaA__AEM92468
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaagaguuuaagccugagauugcagugcgcccaaaagugcgagaccaggaaggacguaugaacuacuauuggacccuggucgagcccggugauaagaucacauucgaagccacuggcaaccuacucguuccuagauacgcuuuugccauggagaggaaugcagggagcggaauuaucauaucggacaccccagugcaugauugcaacacaauuugucaaaccccgaaaggcgcuaucaauacgucucugcccuuccagaacauucacccuaucacuaucgguaagugcccaaaguauguaaaauccacaaaacuucggcuggccaccggguugcgcaaugugcccucaauucagaguagaggacucuuuggcgcgauagccggcuucaucgaagggggauggacugguauggucgacggcugguacggguaucaucaccagaacgagcaaggaagcggcuacgcagcugaccugaaguccacacagaaugccauugauaagaucaccaacaaaguuaauucugugauagagaagaugaacacgcaguuuaccgcuguggguaaggaguucaaucacuuagagaaaaggauugaaaaccugaauaagaaagucgacgauggguuccucgacaucuggacauacaacgccgagcuucugguguugcuagaaaaugagcggacucuggauuaucaugacagcaacguaaagaaccucuacgagaaaguucgcucacagcugaagaauaacgcaaaggaaaucggcaauggauguuuugaguucuaucacaaaugcgauaacaccuguauggaaagugugaagaauggcacauacgacuauccuaaauacuccgaggaagccaaacuuaaccgagaggagauugauggggucaagcuggaaagcacuagaaucuaucaaauuuuggcuauauacucuaccguggcgucaagucucguccuggugguuagcuuaggagcaaucuccuuuuggaugugcucuaaugguucgcugcagugcaggauuuguaucuga

SEQ ID NO: 129097 - RNA, 1701 nt, Artificial Sequence
  derived and/or modified sequence opt3 from hemagglutinin__InfluenzaA__AEM92478
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaauuugucaaaccccgaagggcgcuaucaauacgucucugcccuuccagaacauucacccuaucacuaucgguaagugcccaaaauauguaaaguccacaaaacuucggcuggccaccggguugcgcaaugugcccucaauucagaguagaggacucuuuggcgcgauagccggcuucaucgaagggggauggacugguauggucgacggcugguacggguaucaucaccagaacgaacaaggaagcggcuacgcagcugaccugaaguccacacagaaugccauugauaaaaucaccaacaagguaaauucuguuauagagaagaugaacacgcaguuuaccgcuguggguaaagaguucaaucacuuagaaaagaggauugagaaccugaauaaaaaggucgacgauggguuccucgacaucuggacauacaacgccgaacuucugguguugcuagagaaugaacggacucuggauuaucaugacagcaacgugaaaaaccucuacgagaagguucgcucacagcugaagaauaacgcaaaagagaucggcaauggauguuuugaguucuaucacaagugcgauaacaccuguauggaaagugugaaaaauggcacauacgacuauccuaaguacuccgaagaggccaaacuuaaccgagaagagauugauggggucaagcuggagagcacuagaaucuaucaaauuuuggcuauauacucuaccguggcgucaagucucguccuggugguuagcuuaggagcaaucuccuuuuggaugugcucuaaugguucgcugcagugcaggauuuguaucuga

SEQ ID NO: 129098 - RNA, 1701 nt, Artificial Sequence
  derived and/or modified sequence opt3 from hemagglutinin__InfluenzaA__AEM92498
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaaacucuuggcccaaucacgauagcaacaagggugucaccgccgcuuguccucaugcaggggccaaauccuuuuauaagaaucugaucuggcucgugaaaaagggaaacucauacccaaaauuaaguaagagcuauauaaaugacaagggcaaagaaguacugguucuuuggggcauccaccaccccucuacguccgcugaucaacagucauuguaccagaacgccgacgcguacguguucgucgggacuagccgcuauaguaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucuggaaucauaauuuccgauaccccagcucaugacugcaauacaaccugucaaacgccgaaaggcgccaucaacacuagccuccccuuccagaauauucacccuaucacaaucgguaagugcccaaaguaugugaaaucgaccaagcugcgccuugcgacugggcugagaaacguacccucuauucaguccaggggauuguuuggcgccauagcaggcuucaucgaagggggauggacagguaugguggacggcugguacggguaucaucaccagaaugaacaaggaucaggcuacgcugccgaucucaaaaguacccagaacgcuauugacaagaucacgaauaaagucaacagcgugauagagaagaugaauacccaguuuacagccguugguaaggaguucaaccaccuggaaaaacggauugagaauuuaaacaagaaaguggaugacggguuccuggauaucuggacuuacaaugcagaacuccuuguccuguuggagaacgaacgcacccuagacuaucaugauuccaacgugaagaaucuguacgagaaaguacgaucucagcucaagaacaaugccaaggagaucggcaacggauguuuugaguucuaucacaaaugcgacaauacauguauggaaagcguuaagaacggcacuuacgauuauccuaaauacucagaagaggcuaagcugaauagagaagagauugacggggugaaacuugagaguaccaggaucuaucaaauucuggcgauauacuccacagucgcaagcucuuuggugcucgucgugucacugggagccaucaguuuuuggaugugcagcaacgguuccuuacagugccggauuuguaucuga

SEQ ID NO: 129099 - RNA, 1701 nt, Artificial Sequence
  derived and/or modified sequence opt3 from hemagglutinin__InfluenzaA__AEM92518
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagcgcaaagaaguacugguucuuuggggcauccaccaucccccuacuucagccgaucaacagagcuuguaccagaacgcugacgccuacguguucgucggcaccagucgauauucuaagaaauuuaagccagagauugcgauccgucccaaagugagagaucaggaggggaggaugaauuacuauuggacacugguggaaccuggagacaagauuacuuucgaggcaaccgguaaccuagucguuccacgguacgccuuugcuauggaacgcaacgccggcuccgggaucauaauuagcgauacaccggugcacgacugcaaugcaaccugucaaacgcccaaaggagcuaucaacacuucgcucccuuuccagaauauucacccaaucacaaucggcaagugccccaaguauguaaaaucuaccaagcugagacuugccacuggucugaggaacgugccuuccauucagucacggggguuguuuggagcgauagccggcuucaucgagggcggguggacaggaauggucgacgguugguacggcuaucaucaccagaaugaacaagggaguggauacgcagcugaucucaaaagcacccagaacgccauugacgagaucacgaauaaggugaacuccguuauagagaaaaugaauacccaguuuacagcugugggcaaggaguucaaccaccuggagaagcgcauugaaaauuuaaacaaaaaggucgaugacgguuuccuggauaucuggacuuacaaugccgagcuccuugugcuguuggaaaacgagcgaacccuagacuaucaugauucuaaaguaaagaaucuguacgagaaaguuagaagccagcucaagaacaacgcaaaggaaaucgggaauggcuguuuugaguucuaucacaaaugcgacaacacauguauggaaucagugaagaauggaacuuacgauuauccaaaauacagugaggaagccaagcugaacagggaggagauugacggcgucaaacuugaauccacccggaucuaucaaauucuggcuauauacagcacaguggcgucuucauugguccucgugguuagucugggggcaaucagcuuuuggaugugcuccaauggaucuuuacagugccguauuuguaucuga

SEQ ID NO: 129100 - RNA, 1701 nt, Artificial Sequence
  derived and/or modified sequence opt3 from hemagglutinin__InfluenzaA__AEM92528
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggccuucaaucaccuggagaaacggauugaaaacuuaaauaagaaagucgaugacggguuccuggauaucuggacuuacaacgcagagcuccuugugcuguuggaaaaugagcgcacccuagacuaucaugauucuaacguaaagaaccuguacgaaaaaguucgaaaucagcucaagaacaaugccaaggagaucggcaacggauguuuugaguucuaucacaaaugcgacaauacauguauggaaagcgugaagaacggcacuuacgauuauccuaaauacucagaggaagcuaagcugaauagagaggaaauugacggggucaaacuugagaguaccaggaucuaucaaauucuggcgauauacuccacaguggcaagcucuuugguccucgugguuucacugggagccaucaguuuuuggaugugcagcaacgguuccuuacagugccggauuuguaucuga

SEQ ID NO: 129101 - RNA, 1701 nt, Artificial Sequence
  derived and/or modified sequence opt3 from hemagglutinin__InfluenzaA__AEM92548
augaaggccauccuggugguccuccuuuacaccuucgcuacagcaacugccgacacgcugugcauuggcuaucacgcgaacaauagcaccgauacaguugacacuguguuggagaaaaacguaaccgugacacauuccgucaauuuacuggaagauaagcacaacgggaaacuauguaagcucagaggaguggcuccccugcaucuugguaaaugcaauauagccggcuggauccuggggaacccugagugugaaucuuugucaaccgcaaguagcugguccuacauuguugagacuucuucgucagacaauggaacaugcuauccaggcgauuuuaucaacuacgaggagcucagggagcagcugagcaguguguccucuuucgaacgguuugagauuuucccgaagaccagcuccuggcccaaucacgacucaaacaagggugucacggccgcuuguccucaugcaggggccaaaaguuuuuauaagaaucugaucuggcucgugaaaaagggaaacagcuacccaaaauuaucuaaguccuauauaaaugauaagggcaaagaaguacugguucuuuggggcauccaccaccccucaacuagcgcugaccaacagaguuuguaccagaacgccgaugcguacguguucgucgggaccucucgcuauuccaagaaauuuaagccugagauugcaauccgaccaaaagugcgugaccaggagggaagaaugaauuacuauuggacacugguggaacccggugauaagauuacuuucgaggccaccggcaaccuagucguuccuagguacgcuuuugccauggaacggaacgcagggagcggaaucauaauuucggacacaccagugcaugauugcaauaccacgugucaaacuccgaaaggcgcuaucaacacaucucuccccuuccagaauauucacccuaucaccaucgguaagugcccaaaguauguaaaauccacuaagcugcgccuugccacagggcugagaaacgugcccucaauucagaguaggggauuguuuggcgcgauagccggcuucaucgaagggggauggaccgguauggucgacggcugguacggguaucaucaccagaaugaacaaggaagcggcuacgcagcugaccucaaauccacgcagaacgccauugauaagaucaccaauaaagugaacucuguuauagagaagaugaauacacaguuuacugcuguggguaaggaguucaaccaccuggaaaaacggauugagaauuuaaacaagaaagucgacgauggguuccuggacaucuggaccuacaaugccgaacuccuugugcuguuggagaacgaacgcacacuagauuaucaugacagcaauguaaagaaccuguacgagaaaguucgaaaccagcucaagaauaacgcaaaggagaucggcaauggauguuuugaguucuaucacaaaugcgauaacacuuguauggaaucagugaagaauggcaccuacgacuauccuaaauacagugaagaggccaagcugaacagagaagagauugauggggucaaacuugaguccacaaggaucuaucaaauucuggcuauauacagcaccguggcgucuucauugguccucgugguuagucugggagcaaucagcuuuuggaugugcuccaaugguucuuuacagugccggauuuguaucuga

SEQ ID NO: 129102 - RNA, 1701 nt, Artificial Sequence
  derived and/or modified sequence opt3 from hemagglutinin__InfluenzaA__AEM92558
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcucuauagccggcuggauccuggggaacccugagugugaaucauugaguacagcaagcuccuggucuuacauuguugagaccucgucaagcgacaauggaacuugcuauccaggcgauuuuaucaacuacgaggagcucagggagcagcugaguuccgugucuagcuucgaacgguuugagauuuucccgaagacauccucauggcccaaucacgacaguaacaagggugucaccgccgcuuguccucaugcaggggccaagagcuuuuauaaaaaucugaucuggcucgugaaaaagggaaacucuuacccaaaauuauccaagucauauauaaaugauaagggcaaagaaguacugguucuuuggggcauccaccaccccagcacgacugcugaccaacagaguuuguaccagaacgccgaugcguacguguucgucgggaccucucgcuauuccaagaaauuuaagccugagauugcaauccgaccaaaagugcgugaccaggagggaagaaugaauuacuauuggacacugguggaacccggugauaagauuacuuucgaggccaccggcaaccuagucguuccuagguacgcuuuugccauggaacggaacgcagggagcggaaucauaauuucggacacaccagugcaugauugcaauaccacgugucaaacuccgaaaggcgcuaucaacacaucucuccccuuccagaauauucacccuaucaccaucgguaagugcccaaaguauguaaaauccacuaagcugcgccuugccacagggcugagaaacgugcccucaauucagaguaggggauuguuuggcgcgauagccggcuucaucgaagggggauggaccgguauggucgacggcugguacggguaucaucaccagaaugaacaaggaagcggcuacgcagcugaccucaaauccacgcagaacgccauugauaagaucaccaauaaagugaacucuguuauagagaagaugaauacacaguuuacugcuguggguaaggaguucaaccaccuggaaaaacggauugagaauuuaaacaagaaagucgacgauggguuccuggacaucuggaccuacaaugccgaacuccuugugcuguuggagaacgaacgcacacuagauuaucaugacagcaauguaaagaaccuguacgagaaaguucgaaaccagcucaagaauaacgcaaaggagaucggcaauggauguuuugaguucuaucacaaaugcgauaacacuuguauggaaucagugaagaauggcaccuacgacuauccuaaauacagugaagaggccaagcugaacagagaagagauugauggggucaaacuugaguccacaaggaucuaucaaauucuggcuauauacagcaccguggcgucuucauugguccucgugguuagucugggagcaaucagcuuuuggaugugcuccaaugguucuuuacagugccggauuuguaucuga

SEQ ID NO: 129103 - RNA, 1701 nt, Artificial Sequence; identical to SEQ ID NO: 129102
  derived and/or modified sequence opt3 from hemagglutinin__InfluenzaA__AEM92568

SEQ ID NO: 129104 - RNA, 1701 nt, Artificial Sequence
  derived and/or modified sequence opt3 from hemagglutinin__InfluenzaA__AEM92578
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauuaauuacgaggagcucagggagcagcugucaagcgugaguuccuucgaacgguuugagaucuucccgaagacaucuagcuggcccaaccacgacuccaauaagggugucaccgccgcuuguccucaugcaggggccaaaucauuuuauaagaaccugauauggcucgugaaaaagggaaauaguuacccaaaauuaagcaagucuuauaucaacgauaagggcaaagaaguacugguucuuuggggcauucaccaccccuccacgucagcugaccaacagagcuuguaccagaaugccgaugcguacguguucgucgggacuucccgcuauucuaagaaauuuaagccugagaucgcaauucgaccaaaagugcgugaccaggagggaagaaugaacuacuauuggacccugguggaacccggugauaagaucacauucgaggccacuggcaaccuagucguuccuagguacgcuuuugccauggaacggaaugcaggguccggaauaauuaucagcgacaccccagugcaugauugcaacacaaccugucaaacgccgaaaggcgcuauuaauacuucgcuccccuuccagaacauccacccuaucacaauugguaagugcccaaaguauguaaaaucuaccaagcugcgccuugccacugggcugagaaaugugcccuccauacagucaaggggauuguuuggcgcgaucgccggcuucauugaagggggauggacagguauggucgacggcugguacggguaucaucaccagaacgaacaaggaaguggcuacgcagcugaccucaaaagcacccagaaugccaucgauaagauaacgaacaaagugaauaguguuauugagaagaugaacacccaguuuacagcuguggguaaggaguucaaucaccuggaaaaacggaucgagaacuuaaauaagaaagucgacgauggguuccuggacaucuggacuuacaacgccgaacuccuugugcuguuggagaaugaacgcacccuagauuaucaugacucuaacguaaagaaccuguacgagaaaguucgaaaucagcucaagaacaaugcaaaggagauuggcaacggauguuuugaguucuaucacaaaugcgauaauacauguauggaaagcgugaagaacggcacuuacgacuauccuaaauacucagaagaggccaagcugaauagagaagagaucgauggggucaaacuugagaguaccaggauuuaucaaauacuggcuaucuacuccacaguggcgagcucuuugguccucgugguuucacugggagcaauuaguuuuuggaugugcagcaacgguuccuuacagugccggaucuguaucuga

SEQ ID NO: 129105 - RNA, 1701 nt, Artificial Sequence
  derived and/or modified sequence opt3 from hemagglutinin__InfluenzaA__AEM92608
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacgcguacguguucgucgggaccagucgcuauucuaagaaauuuaagccugagauugcaauccgaccaaaagugcgugaucaggagggaagaaugaauuacuauuggacacugguggaacccggugacaagauuacuuucgaggccaccggcaaccuagucguuccuagguacgcuuuugccauggaacggaacgcaggguccggaaucauaauuagcgauacaccagugcaugacugcaauaccacgugucaaacuccgaaaggcgcuaucaacacaucgcuccccuuccagaauauucacccuaucaccaucgguaagugcccaaaguauguaaaaucuacuaagcugcgccuugccacagggcugagaaacgugcccuccauucagucaaggggauuguuuggcgcgauagccggcuucaucgaagggggauggaccgguauggucgacggcugguacggguaucaucaccagaaugaacaaggaaguggcuacgcagcugaucucaaaagcacgcagaacgccauugacaagaucaccaauaaagugaacuccguuauagagaagaugaauacacaguuuacugcuguggguaaggaguucaaccaccuggaaaaacggauugagaauuuaaacaagaaagucgaugacggguuccuggauaucuggaccuacaaugccgaacuccuugugcuguuggagaacgaacgcacacuagacuaucaugauucuaauguaaagaaccuguacgagaaaguucgaaaccagcucaagaauaacgcaaaggagaucggcaauggauguuuugaguucuaucacaaaugcgacaacacuuguauggaaagcgugaagaauggcaccuacgauuauccuaaauacucagaagaggccaagcugaacagagaagagauugacggggucaaacuugagaguacaaggaucuaucaaauucuggcuauauacuccaccguggcgagcucuuugguccucgugguuucacugggagcaaucaguuuuuggaugugcagcaaugguuccuuacagugccggauuuguaucuga

SEQ ID NO: 129106 - RNA, 1701 nt, Artificial Sequence
  derived and/or modified sequence opt3 from hemagglutinin__InfluenzaA__AEM92618
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaaacucuuggcccaaucacgauagcaacaagggugucaccgccgcuuguccucaugcaggggccaaauccuuuuauaagaaucugaucuggcucgugaaaacgggaaacucauacccaaaguuaaguaaaagcuauauaaaugacaagggcaaggaaguacugguucuuuggggcauccaccaccccucuacuuccgcugaucaacagucauuguaccagaacgccgacgcguacguguucgucgggaccagccgcuauagucgaaaauuuaagccugagauugcaauccguccaaaagugagagaucaggagggaaggaugaacuacuauuggacacugguggaacccggugacaagauuacuuucgaggccaccggcaaucuagucguuccucgguacgcuuuugccauggaacgcaacgcagggucuggaaucauaauuuccgauacaccagcucaugacugcaauaccacgugucaaacuccgaaaggcgccaucaacacaagccuccccuuccagaauauucacccuaucaccaucgguaagugcccaaaauaugugaagucgacuaagcugagacuugcgacagggcugaggaacguacccucuauucagucccggggauuguuuggcgccauagcaggcuucaucgaagggggauggaccgguaugguggacggcugguacggguaucaucaccagaaugaacaaggaucaggcuacgcugccgaucucaaaaguacgcagaacgcuauugacaagaucaccaauaaagucaacagcgugauagagaagaugaauacacaguuuacugccguugguaaagaguucaaccaccuggaaaagcgcauugagaauuuaaacaagaaaguggaugacggguuccuggauaucuggaccuacaaugcagaacuccuuguccuguuggagaacgaacgaacacuagacuaucaugauuccaacgugaagaaucuguacgagaaaguaagaucucagcucaagaacaaugccaaagagaucggcaacggauguuuugaguucuaucacaagugcgacaauacuuguauggaaagcguuaagaacggcaccuacgauuauccuaaauacucagaagaggcuaagcugaauagggaagagauugacggggugaaacuugagaguacacggaucuaucaaauucuggcgauauacuccaccgucgcaagcucuuuggugcucgucgugucacugggagccaucaguuuuuggaugugcagcaacgguuccuuacagugccguauuuguaucuga

SEQ ID NO: 129107 - RNA, 1701 nt, Artificial Sequence
  derived and/or modified sequence opt3 from hemagglutinin__InfluenzaA__AEM92638
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauaccaacaagggugucacggccgcuuguccucaugcaggggccaaaucauuuuauaagaaucugauauggcuggugaaaaagggaaacaguuacccaaaacucagcaagucuuauaucaaugacaagggcaaagaaguauuaguucuguggggcauucaccaccccuccacuucagcugaucaacagagccuuuaccagaacgccgacgcguacguguucgucgggaguucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaaaagaacgcagggagcggaauaauuaucucggauaccccagugcaugacugcaauacaaccugucaaacgccgaaaggcgcuauuaacacuucucuacccuuccagaauauccacccuaucacaauugguaagugcccaaaauauguaaaguccaccaaacuccggcuggccacugggcuucgcaacgugcccucaauacagaguagaggacuguuuggcgcgaucgccggcuucauugaagggggauggacagguauggucgacggcugguacggguaucaucaccagaaugaacaaggaagcggcuacgcagcugauuugaaguccacccagaacgccaucgacgagauaacgaauaaagugaacucuguuauugagaagaugaauacccaguuuacagcuguggguaaggaguucaaccaccucgagaaaaggaucgaaaaucugaacaagaaagucgaugacggguucuuagauaucuggacuuacaaugccgagcugcucgugcuucuggaaaacgagcggaccuuggacuaucaugauagcaauguaaagaaccuauacgagaaaguucgcucacagcugaagaacaaugcaaaggaagugggcaacggauguuuugaguucuaucacaaaugcgacaauacauguauggaaagugucaagaacggcacuuacgauuauccuaaauacuccgaggaagccaagcucaaucgagaggagauugacggggugaaacuggaaagcaccagaaucuaucaaauucuugcuauauacucuacagcggcaucaagucuggucuuggugguuagccucggagccaucuccuuuuggaugugcucuaacgguucgcugcagugcaggauuuguaucuga

SEQ ID NO: 129108 - RNA, 1701 nt, Artificial Sequence
  derived and/or modified sequence opt3 from hemagglutinin__InfluenzaA__AEM92648
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauaccaacaagggugucacggccgcuuguccucaugcaggggccaaaucauuuuauaagaaucugauauggcuggugaaagaaggaaacaguuacccaaagcucagcaaaucuuauaucaaugacaagggcaaggagguauuaguucuguggggcauucaccaccccuccacuucagcugaucaacagagccuuuaccagaacgccgacgcguacguguucgucgggaguucucgcuauuccaaaaaguuuaaaccugagaucgcaauucgaccaaaggugcgugaucaggaaggaagaaugaauuacuauuggaccuugguggagcccggugacaaaaucacauucgaagccacuggcaaccuggucguuccuagguacgcuuuugccauggagaagaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccggcuggccacugggcuucgcaacgugcccucaauacagaguagaggacuguuuggcgcgaucgccggcuucauugaagggggauggacagguauggucgacggcugguacggguaucaucaccagaaugagcaaggaagcggcuacgcagcugauuugaaauccacccagaacgccaucgacgagauaacgaauaaggugaacucuguuauugaaaagaugaauacccaguuuacagcuguggguaaagaguucaaccaccucgaaaagaggaucgagaaucugaacaaaaaggucgaugacggguucuuagauaucuggacuuacaaugccgaacugcucgugcuucuggagaacgagcggaccuuggacuaucaugauagcaauguuaaaaaccuauacgaaaagguacgcucacagcugaaaaacaaugcaaaggaggugggcaacggauguuuugaguucuaucacaagugcgacaauacauguauggaaagugucaaaaacggcacuuacgauuauccuaaguacuccgaagaggccaaacucaaucgagaggaaauugacggggugaagcuggagagcaccagaaucuaucaaauucuugcuauauacucuacagcggcaucaagucuggucuuggugguuagccucggagccaucuccuuuuggaugugcucuaacgguucgcugcagugcaggauuuguaucuga

SEQ ID NO: 129109 - RNA, 1701 nt, Artificial Sequence; identical to SEQ ID NO: 127549
  derived and/or modified sequence opt3 from hemagglutinin__InfluenzaA__AEM98407

SEQ ID NO: 129110 - RNA, 1701 nt, Artificial Sequence; identical to SEQ ID NO: 127549
  derived and/or modified sequence opt3 from hemagglutinin__InfluenzaA__AEM98418

SEQ ID NO: 129111 - RNA, 1701 nt, Artificial Sequence; identical to SEQ ID NO: 127549
  derived and/or modified sequence opt3 from hemagglutinin__InfluenzaA__AEM98429

SEQ ID NO: 129112 - RNA, 1701 nt, Artificial Sequence
  derived and/or modified sequence opt3 from hemagglutinin__InfluenzaA__AEN55398
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuuguaacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129113 - RNA, 1701 nt, Artificial Sequence; identical to SEQ ID NO: 128936
  derived and/or modified sequence opt3 from hemagglutinin__InfluenzaA__AEN55408

SEQ ID NO: 129114 - RNA, 1701 nt, Artificial Sequence; identical to SEQ ID NO: 128451
  derived and/or modified sequence opt3 from hemagglutinin__InfluenzaA__AEN55418

SEQ ID NO: 129115 - RNA, 1701 nt, Artificial Sequence; identical to SEQ ID NO: 127600
  derived and/or modified sequence opt3 from hemagglutinin__InfluenzaA__AEN55463

SEQ ID NO: 129116 - RNA, 1701 nt, Artificial Sequence
  derived and/or modified sequence opt3 from hemagglutinin__InfluenzaA__AEN55473
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacuaccgaucaacagagcuuguaccagacagcugacacuuacguguucgucgggaccagucgcuauucuaagaaauuuaagccugagauugccauccgaccaaaagugcgugaucaggagggaagaaugaacuacuauuggacacugguggaacccggugacaagauuaccuucgaggcgacgggcaaucuagucguuccuagguacgcauuugccauggaacggaacgcuggguccggaaucauaauuagcgauacuccagugcaugacugcaacacaaccugucaaacuccgaaaggcgccaucaauacaucgcuccccuuccagaacauucacccuaucaccaucgguaagugcccaaaguauguaaaaucuacgaagcugcgccuugcaaccgggcugagaaaugugcccuccauucagucaaggggauuguuuggcgcuauagccggcuucaucgaagggggauggacagguauggucgacggcugguacggguaucaucaccagaacgaacaaggaaguggcuacgcggccgaucucaaaagcacucagaaugcaauugacaagaucaccaacaaaguuaauuccgugauagagaagaugaacacacaguuuacugcuguggguaaggaguucaaucaccuggaaaaacggauugagaacuuaaauaagaaagucgaugacggguuccuggauaucuggaccuacaacgccgaacuccuugugcuguuggagaaugaacgcacacuagacuaucaugauucuaacguaaagaaucuguacgagaaaguucgaaaccagcucaagaccaacgcuaaggagaucggcaauggauguuuugaguucuaucacaaaugcgacaacacuuguauggaaagcgugaagaauggcacguacgauuauccuaaauacucagaagaggccaagcugaacagagaagagauugacggggucaaacuugagaguacaaggaucuaucaaauucuggcaauauacuccaccguggccagcucuuugguccucgugguuucacugggagcuaucaguuuuuggaugugcagcaaugguuccuuacagugccggauuuguaucuga

SEQ ID NO: 129117 - RNA, 1701 nt, Artificial Sequence; identical to SEQ ID NO: 128451
  derived and/or modified sequence opt3 from hemagglutinin__InfluenzaA__AEN55483

SEQ ID NO: 129118 - RNA, 1701 nt, Artificial Sequence; identical to SEQ ID NO: 129058
  derived and/or modified sequence opt3 from hemagglutinin__InfluenzaA__AEN55493

SEQ ID NO: 129119 - RNA, 1701 nt, Artificial Sequence; identical to SEQ ID NO: 128451
  derived and/or modified sequence opt3 from hemagglutinin__InfluenzaA__AEN55503

SEQ ID NO: 129120 - RNA, 1701 nt, Artificial Sequence
  derived and/or modified sequence opt3 from hemagglutinin__InfluenzaA__AEN55513
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagaacuuguaccagaaugccgacaccuacguguucgucgggacaagccgcuauaguaagaaauuuaagccugagauugcgauccgaccaaaagugcgugaucaggagggaagaaugaacuacuauuggacucugguggaacccggugacaagauuaccuucgaggcaacaggcaaccuagucguuccuagguacgccuuugcuauggaacggaaugccgggucuggaaucauaauuuccgauaccccagugcaugacugcaacacgacuugucaaacaccgaaaggcgcaaucaauaccagccuccccuuccagaacauucacccuaucacuaucgguaagugcccaaaguauguaaaaucgacaaagcugcgccuugcuaccgggcugagaaaugugcccucuauucaguccaggggauuguuuggcgccauagcgggcuucaucgaagggggauggacggguauggucgacggcugguacggguaucaucaccagaacgaacaaggaucaggcuacgccgcagaucucaaaaguacccagaaugcuauugacaagaucacaaacaaagugaauagcguuauagagaagaugaacacucaguuuaccgccguggguaaggaguucaaucaccuggaaaaacggauugagaacuuaaauaagaaagucgaugacggguuccuggauaucuggacauacaacgcugaacuccuugugcuguuggagaaugaacgcacucuagacuaucaugauuccaacguaaagaaccuguacgagaaaguucgaaaucagcucaagaacaaugccaaggagaucggcaacggauguuuugaguucuaucacaaaugcgacaauaccuguauggaaucugugaagaacggcacauacgauuauccuaaauacagcgaagaggcaaagcugaauagagaagagauugacggggucaaacuugagucaaccaggaucuaucaaauucuggccauauacaguacuguggcuuccagcuugguccucgugguuucucugggagcgaucucauuuuggaugugcaguaacgguagcuuacagugccggauuuguaucuga

SEQ ID NO: 129121 - RNA, 1701 nt, Artificial Sequence; identical to SEQ ID NO: 128451
  derived and/or modified sequence opt3 from hemagglutinin__InfluenzaA__AEN55523

SEQ ID NO: 129122 - RNA, 1701 nt, Artificial Sequence; identical to SEQ ID NO: 127240
  derived and/or modified sequence opt3 from hemagglutinin__InfluenzaA__AEN68904

SEQ ID NO: 129123 - RNA, 1701 nt, Artificial Sequence; identical to SEQ ID NO: 124685
  derived and/or modified sequence opt3 from hemagglutinin__InfluenzaA__AEN68905

SEQ ID NO: 129124 - RNA, 1701 nt, Artificial Sequence; identical to SEQ ID NO: 124685
  derived and/or modified sequence opt3 from hemagglutinin__InfluenzaA__AEN68906

SEQ ID NO: 129125 - RNA, 1701 nt, Artificial Sequence; identical to SEQ ID NO: 125787
  derived and/or modified sequence opt3 from hemagglutinin__InfluenzaA__AEN68907

SEQ ID NO: 129126 - RNA, 1701 nt, Artificial Sequence; identical to SEQ ID NO: 124685
  derived and/or modified sequence opt3 from hemagglutinin__InfluenzaA__AEN68908

SEQ ID NO: 129127 - RNA, 1701 nt, Artificial Sequence
  derived and/or modified sequence opt3 from hemagglutinin__InfluenzaA__AEN68909
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 129128 - RNA, 1701 nt, Artificial Sequence
  derived and/or modified sequence opt3 from hemagglutinin__InfluenzaA__AEN68910
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaagaacucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaagggaccaagcugcgccuugccacuggacugagaaacguccccuccauccagucaaggggcuuguuuggcgcgauugccggguucauagagggagguuggacaggcaugguggacgggugguacggauaucaucaccagaaugaacaaggcagugguuacgcagcugaucucaaaagcacccagaacgccaucgacgagauuacgaauaagguuaacuccgugaucgagaaaaugaauacccaguuuacagcugucgggaaggaguucaaccaccuggagaagcggauagaaaauuuaaacaaaaagguggaugacggcuuccuggauauuuggacuuacaaugccgagcuccuuguacuguuggaaaacgagcgcacccuagacuaucaugauucuaauguuaaaaaccuguacgagaaggugcgaagccagcucaaaaacaaugcaaaggaaaucggaaacggcuguuuugaguucuaucacaagugcgacaauacauguauggaaucagucaaaaacgggacuuacgauuauccuaaguacagugaggaagccaaacugaauagagaggagaucgacggagugaaacuugaauccaccaggauuuaucaaauccuggcuauuuacagcacagucgcgucuucauuggugcucguugugagucugggugcaaucagcuuuuggaugugcuccaacggcucuuuacagugccggauauguauuuga

SEQ ID NO: 129129 - RNA, 1701 nt, Artificial Sequence; identical to SEQ ID NO: 126801
  derived and/or modified sequence opt3 from hemagglutinin__InfluenzaA__AEN68911

SEQ ID NO: 129130 - RNA, 1701 nt, Artificial Sequence; identical to SEQ ID NO: 124685
  derived and/or modified sequence opt3 from hemagglutinin__InfluenzaA__AEN68912

SEQ ID NO: 129131 - RNA, 1701 nt, Artificial Sequence; identical to SEQ ID NO: 124776
  derived and/or modified sequence opt3 from hemagglutinin__InfluenzaA__AEN68913

SEQ ID NO: 129132 - RNA, 1701 nt, Artificial Sequence; identical to SEQ ID NO: 127351
  derived and/or modified sequence opt3 from hemagglutinin__InfluenzaA__AEN68914

SEQ ID NO: 129133 - RNA, 1701 nt, Artificial Sequence; identical to SEQ ID NO: 124685
  derived and/or modified sequence opt3 from hemagglutinin__InfluenzaA__AEN68915

SEQ ID NO: 129134 - RNA, 1701 nt, Artificial Sequence; identical to SEQ ID NO: 124685
  derived and/or modified sequence opt3 from hemagglutinin__InfluenzaA__AEN68916

SEQ ID NO: 129135 - RNA, 1701 nt, Artificial Sequence
  derived and/or modified sequence opt3 from hemagglutinin__InfluenzaA__AEN68917
augaaggccauccugggcgugcuccuuuacaccuucgcuacagcaaacgccgacacucugugcauuggguaucacgcgaauaacagcacggauaccgucgacacaguuuuggagaaaaaugugacuguaacccauuccgugaacuuacuggaagauaagcacaauggaaaacuauguaagcucagaggugucgcuccccugcaucuuggcaaaugcaacauagccggguggauccugggaaauccugagugugaaucuuugucaacagcaaguagcugguccuacauuguggagaccucuucgucagacaacggcacuugcuauccaggugauuuuaucgacuacgaagaacucagggagcagcugagcaguguuuccucuuucgaacgguuugagauuuucccgaagacaagcuccuggcccaaucacgauucaaacaagggggugaccgccgcuuguccucaugcaggagccaaaaguuuuuauaagaaucugaucuggcucgucaaaaagggcaacagcuacccaaaauuaucuaaguccuauauaaaugacaagggcaaagaagugcugguacuuugggggauccaccaccccucaacgagcgcugaucaacagaguuuguaccagaacgccgacgcguacguuuucgugggaacuucucgcuauuccaagaaauuuaagccugagauugcaauccgaccaaaaguccgugaucaggaggguagaaugaauuacuauuggacccugguggaacccggcgacaagauuacauucgaggccacugggaaccuaguggucccuagguacgcuuuugccauggaacggaacgcaggaagcggcaucauaauuucggauaccccaguucaugacugcaauacaaccugucaaacgccgaaaggugcuaucaacacuucucuccccuuccagaauauucacccugugacaaucgggaagugcccaaaguauguaaaauccaccaagcugcgccuugccacuggacugagaaacgugcccucaauccagaguaggggcuuguuuggcgcgauugccggguucauagagggagguuggacaggcauggucgacgggugguacggauaucaucaccagaaugaacaaggcagcgguuacgcagcugaucucaaauccacccagaacgccaucgacaagauuacgaauaaagugaacucuguuaucgagaagaugaauacccaguuuacagcuguggggaaggaguucaaccaccuggaaaaacggauagagaauuuaaacaagaaagucgaugacggcuuccuggauauuuggacuuacaaugccgaacuccuugugcuguuggagaacgaacgcacccuagacuaucaugauagcaauguaaagaaccuguacgagaaaguucgaucacagcucaagaacaaugcaaaggagaucggaaacggcuguuuugaguucuaucacaaaugcgacaauacauguauggagagugugaagaacgggacuuacgauuauccuaaauacuccgaagaggccaagcugaauagagaagagaucgacggagucaaacuugagagcaccaggauuuaucaaauccuggcuauuuacucuacaguggcgucaaguuugguccucgugguuagccugggugcaauauccuuuuggaugugcucuaacggcucguuacagugccggaucuguauuuga

SEQ ID NO: 129136 - RNA, 1701 nt, Artificial Sequence
  derived and/or modified sequence opt3 from hemagglutinin__InfluenzaA__AEN68918
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagaauaacgggaaacuauguaagcucagaggaguggcuccccugcaccuugguaaaugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauguucccgaagacaagcuccuggcccaaccaugauucaaauaagggugucaccgccgcuuguccucacgcaggggccaaaaguuuuuauaagaaccugauuuggcucgugaaaaagggaaauagcuacccaaaauuaucuaaguccuauaucaacgacaagggcaaagaaguacugguucuuuggggcauacaucaccccucaacgagcgcugaucaacagaguuuguaccagaaugccgacgcguacguguucgucgggacuucucgcuauuccaagaaauuuaagccugagaucgcaauucgaccaaaagugcgugaucaggagggaagaaugaacuacuauuggacccugguggaacccggugacaagaucacauucgaggccacuggcaaccuagucguuccuagguacgcuuuugccauggaacggaaugcagggagcggaauuaucauaucggauaccccagugcacgacugcaacacaaccugucaaacgccgaaaggcgcuauuaauacuucucuccccuuccagaacauccauccuauuacaaucgguaagugcccaaaguauguaaaauccaccaagcugcgccuugccacugggcugagaaaugugcccucaauccagaguaggggauuguuuggcgcgauugccggcuucauagaagggggauggacagguauggucgacggcugguacggguaucaccaucagaacgaacaaggaagcggcuacgcagcugaucucaaauccacccagaaugccaucgacgagauuacgaacaagguaaauucuguuaucgagaaaaugaacacccaguuuacagcuguggguaaggaguucaaucaccuggaaaagcggauagaaaacuuaaauaaaaaggucgaugacggguuccuggauauuuggacuuacaacgccgagcuccuugugcuguuggaaaaugagcgcacccuagacuaucacgauagcaacgugaaaaaccuguacgagaagguucgaucacagcucaaaaauaacgcaaaggaagugggcaauggauguuuugaguucuaucauaagugcgacaacacauguauggaaagugucaaaaauggcacuuacgauuauccuaaguacuccgaggaagccaaacugaacagagaggagaucgacggggugaaacuugaaagcaccaggaucuaucaaauucuggcuaucuacucuacagucgcgucaaguuuggugcucguugugagccugggagcaauuuccuuuuggaugugcucuaaugguucguuacagugccggauauguaucuga

SEQ ID NO: 129137 - RNA, 1701 nt, Artificial Sequence; identical to SEQ ID NO: 127600
  derived and/or modified sequence opt3 from hemagglutinin__InfluenzaA__AEN68919

SEQ ID NO: 129138 - RNA, 1701 nt, Artificial Sequence; identical to SEQ ID NO: 126849
  derived and/or modified sequence opt3 from hemagglutinin__InfluenzaA__AEN68920

SEQ ID NO: 129139 - RNA, 1701 nt, Artificial Sequence; identical to SEQ ID NO: 125849
  derived and/or modified sequence opt3 from hemagglutinin__InfluenzaA__AEN68921

SEQ ID NO: 129140 - RNA, 1701 nt, Artificial Sequence; identical to SEQ ID NO: 125845
  derived and/or modified sequence opt3 from hemagglutinin__InfluenzaA__AEN68922

SEQ ID NO: 129141 - RNA, 1701 nt, Artificial Sequence; identical to SEQ ID NO: 125849
  derived and/or modified sequence opt3 from hemagglutinin__InfluenzaA__AEN68923

SEQ ID NO: 129142 - RNA, 1701 nt, Artificial Sequence; identical to SEQ ID NO: 125849
  derived and/or modified sequence opt3 from hemagglutinin__InfluenzaA__AEN68924

SEQ ID NO: 129143 - RNA, 1701 nt, Artificial Sequence
  derived and/or modified sequence opt3 from hemagglutinin__InfluenzaA__AEN68925
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgagacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacaagaucacgaauaaagugaacucuguuauagagaagaugaauacccaguuuacagcugugggcaaggaguucaaccaccuggagaaacggauugaaaauuuaaacaagaaagucgaugacgguuuccuggauaucuggacuuacaaugccgagcuccuugugcuguuggaaaacgagcgcacccuagacuaucaugauagcaauguaaagaaccuguacgagaaaguucgaucacagcucaagaacaaugcaaaggaaaucgggaacggcuguuuugaguucuaucacaaaugcgacaauacauguauggaaagugugaagaacggaacuuacgauuauccuaaauacuccgaggaagccaagcugaauagagaggagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 129144 - RNA, 1701 nt, Artificial Sequence
  derived and/or modified sequence opt3 from hemagglutinin__InfluenzaA__AEN68926
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuggcaacagccucaaguuggagcuacauuguugagaccuccaacucugacaauggaacuugcuauccaggcgauuuuaucgacuacgaggagcucagggagcagcugucgucagugagcaguuucgaacgguuugagauuuucccgaagacauccucuuggcccaaccacgauagcaauaagggugucaccgcugcauguccucaugccggggcuaaauccuuuuauaagaaccugaucuggcucgugaaaaagggaaauucauacccaaaauuaaguaagagcuauauaaacgacaagggccgcgaaguacugguucuuuggggcauccaccaccccucuacguccgccgaucaacagucauuguaccagaaugcggacacuuacguguucgucgggaccagccgauauaguaaaaaguuuaaaccugagauugcaauccguccaaaggugagagaucaggagggaaggaugaacuacuauuggacacugguggaacccggugacaaaauuacuuucgaggccaccggcaaccuagucguuccucgguacgcuuuugccauggaacgcaaugcagggucuggaaucauaauuuccgauacaccagugcaugacugcaacaccacgugucaaacuccgaagggcgcuaucaauacaagccuccccuuccagaacauucacccuaucaccaucgguaaaugcccaaaguauguaaagucgacuaaacugagacuugccacagggcugaggaaugugcccucuauucagucccggggauuguuuggcgcgauagccggcuucaucgaagggggauggaccgguauggucgacggcugguacggguaucaucaccagaacgaacaaggaucaggcuacgcagcugaucucaagaguacgcagaaugccauugacgagaucaccaacaaagugaauagcguuauagagaagaugaacacacaguuuacugcuguggguaaagaguucaaucaccuggaaaagcgcauugaaaacuuaaauaagaaagucgaugacggguuccuggauaucuggaccuacaacgccgagcuccuugugcuguuggaaaaugagcgaacacuagacuaucaugauuccaacguaaagaaccuguacgagaaaguuagaucucagcucaagaauaacgcaaaagaaaucggcaauggauguuuugaguucuaucacaagugcgacaacacuuguauggaaagcgugaagaauggcaccuacgauuauccuaaauacucagaggaagccaagcugaacagggaggagauugacggggucaaacuugaaaguacacggaucuaucaaauucuggcuauauacuccaccguggcgagcucuuugguccucgugguuucacugggagcaaucaguuuuuggaugugcagcaaugguuccuuacagugccguauuuguaucuga

SEQ ID NO: 129145 - RNA, 1701 nt, Artificial Sequence
  derived and/or modified sequence opt3 from hemagglutinin__InfluenzaA__AEN68927
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaaaccagcucaagaacaaugcaaaggagaucggcaacggauguuuugaguucuaucacaaaugcgauaauacauguauggaaucagugaagaacggcacuuacgacuauccuaaauacagugaagaggccaagcugaauagagaagagauugauggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129146 - RNA, 1701 nt, Artificial Sequence; identical to SEQ ID NO: 128271
  derived and/or modified sequence opt3 from hemagglutinin__InfluenzaA__AEN68928

SEQ ID NO: 129147 - RNA, 1701 nt, Artificial Sequence
  derived and/or modified sequence opt3 from hemagglutinin__InfluenzaA__AEN68929
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129148 - RNA, 1701 nt, Artificial Sequence; identical to SEQ ID NO: 127600
  derived and/or modified sequence opt3 from hemagglutinin__InfluenzaA__AEN68930

SEQ ID NO: 129149 - RNA, 1701 nt, Artificial Sequence; identical to SEQ ID NO: 127600
  derived and/or modified sequence opt3 from hemagglutinin__InfluenzaA__AEN68931

SEQ ID NO: 129150 - RNA, 1701 nt, Artificial Sequence; identical to SEQ ID NO: 127600
  derived and/or modified sequence opt3 from hemagglutinin__InfluenzaA__AEN68932

SEQ ID NO: 129151 - RNA, 1701 nt, Artificial Sequence
  derived and/or modified sequence opt3 from hemagglutinin__InfluenzaA__AEN69426
augaaggccauccuggugguccuccuuuacaccuucgcuacaagcaacgcagacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcaauuuuaucgauuacgaggagcucagggagcagcugaguuccgugucuagcuucgaacgguuugagauuuucccgaagacauccucauggcccgaccacgauaguaacaagggugucaccgcagccuguccucaugcuggggcaaagagcuuuuauaaaaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucgccccuagguacgcuuuugccauggaacggaacgcagggucgggaaucauaauuucugauaccccaguucaugacugcaauacaaccugucaaacgccgaaaggcgcuaucaacacuucccuccccuuccagaauauucacccuaucacaaucgguaagugcccaaaguaugugaaaucaaccaagcugcgccuugccacugggcugagaaacguacccaguauucagagcaggggauuguuuggcgcgauagccggcuucaucgaagggggauggacagguaugguggacggcugguacggguaucaucaccagaaugaacaaggauccggcuacgcagcugaucucaaaucuacccagaacgccauugacaagaucacgaauaaagucaacagcgugauagagaagaugaauacccaguuuacagcuguugguaaggaguucaaccaccuggaaaaacggauugagaauuuaaacaagaaaguggaugacggguuccuggauaucuggacuuacaaugccgaacuccuuguccuguuggagaacgaacgcacccuagacuaucaugauucaaaugugaagaaccuguacgagaaaguacgaagucagcucaagaacaaugcaaaggagaucggcaacggauguuuugaguucuaucacaaaugcgacaauacauguauggaauccguuaagaacggcacuuacgauuauccuaaauacagcgaagaggccaagcugaauagagaagagauugacggggugaaacuugagucuaccaggaucuaucaaauucuggcuauauacucaacagucgcgaguagcuuggugcucgucgugucccugggagcaaucucuuuuuggaugugcucgaacgguagcuuacagugccggauuuguaucuga

SEQ ID NO: 129152 - RNA, 1701 nt, Artificial Sequence; identical to SEQ ID NO: 128936
  derived and/or modified sequence opt3 from hemagglutinin__InfluenzaA__AEN69475

SEQ ID NO: 129153 - RNA, 1701 nt, Artificial Sequence; identical to SEQ ID NO: 128936
  derived and/or modified sequence opt3 from hemagglutinin__InfluenzaA__AEN69481

SEQ ID NO: 129154 - RNA, 1701 nt, Artificial Sequence; identical to SEQ ID NO: 124938
  derived and/or modified sequence opt3 from hemagglutinin__InfluenzaA__AEO01032

SEQ ID NO: 129155 - RNA, 1701 nt, Artificial Sequence; identical to SEQ ID NO: 125038
  derived and/or modified sequence opt3 from hemagglutinin__InfluenzaA__AEO01033

SEQ ID NO: 129156 - RNA, 1701 nt, Artificial Sequence; identical to SEQ ID NO: 125038
  derived and/or modified sequence opt3 from hemagglutinin__InfluenzaA__AEO01034

SEQ ID NO: 129157 - RNA, 1701 nt, Artificial Sequence; identical to SEQ ID NO: 124672
  derived and/or modified sequence opt3 from hemagglutinin__InfluenzaA__AEO01035

SEQ ID NO: 129158 - RNA, 1701 nt, Artificial Sequence; identical to SEQ ID NO: 125038
  derived and/or modified sequence opt3 from hemagglutinin__InfluenzaA__AEO01036

SEQ ID NO: 129159 - RNA, 1701 nt, Artificial Sequence; identical to SEQ ID NO: 124927
  derived and/or modified sequence opt3 from hemagglutinin__InfluenzaA__AEO01037

SEQ ID NO: 129160 - RNA, 1701 nt, Artificial Sequence; identical to SEQ ID NO: 125038
  derived and/or modified sequence opt3 from hemagglutinin__InfluenzaA__AEO01038

SEQ ID NO: 129161 - RNA, 1701 nt, Artificial Sequence; identical to SEQ ID NO: 124865
  derived and/or modified sequence opt3 from hemagglutinin__InfluenzaA__AEO01039

SEQ ID NO: 129162 - RNA, 1701 nt, Artificial Sequence
  derived and/or modified sequence opt3 from hemagglutinin__InfluenzaA__AEO01040
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaaaagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugauugagcccggugacaaaaucacauucgaagccacuggcaaccuaguggucccuagguacgcuuuuaccauggagcggaacgccgggagcggaauaauuaucucggauacaccaguucaugacugcaauaccacgugucaaacuccgaagggcgcaauuaacacaucucuccccuuccagaauauccacccuaucaccauugguaagugcccaaaauaugugaaguccacuaaacugcgccuugcuacagggcugagaaacguacccucaauacagaguaggggauuguuuggcgccaucgcgggcuucauugaagggggauggaccgguaugguggacggcugguacggguaucaucaccagaaugagcaaggaagcggcuacgccgcagaucucaaguccacgcagaacgcuaucgacgaaauaaccaauaaagucaacucugugauugagaagaugaauacacaguuuacugccguugguaaggaguucaaccaccuggaaaaacggaucgagaauuuaaacaagaaaguggaugacggguuccuggauaucuggaccuacaaugcugaacuccuuguccuguuggagaacgaacgcacacuagacuaucaugauagcaaugugaagaaccuguacgagaaaguacgaucacagcucaagaacaaugccaaggagauuggcaacggauguuuugaguucuaucacaaaugcgacaauacuuguauggagaguguuaagaacggcaccuacgauuauccuaaauacuccgaagaggcaaagcugaauagagaagagaucgacggggugaaacuugagagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 129163 - RNA, 1701 nt, Artificial Sequence; identical to SEQ ID NO: 124685
  derived and/or modified sequence opt3 from hemagglutinin__InfluenzaA__AEO01041

SEQ ID NO: 129164 - RNA, 1701 nt, Artificial Sequence; identical to SEQ ID NO: 125038
  derived and/or modified sequence opt3 from hemagglutinin__InfluenzaA__AEO01042

SEQ ID NO: 129165 - RNA, 1701 nt, Artificial Sequence
  derived and/or modified sequence opt3 from hemagglutinin__InfluenzaA__AEO01043
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaaacaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugagcaggaaggaagaaugaacuacuauuggacccugguggagcccggugacaagauuacauucgaagccacuggcaaccuagucguuccuagguacgcuuuugccauggagcggaaugcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgagcaaggaagcggcuacgcagcugaccucaaauccacccagaaugccauugacgagaucacgaacaagguaaauucuguuauagaaaagaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugagcgcacccuagacuaucaugauagcaacgugaaaaaccuguacgaaaagguucgaucacagcucaaaaauaacgcaaaggagaucggcaauggauguuuugaguucuaucacaagugcgacaacacauguauggagagugugaaaaauggcacuuacgauuauccuaaguacuccgaagaggccaaacugaacagagaggaaauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129166 - RNA, 1701 nt, Artificial Sequence; identical to SEQ ID NO: 124685
  derived and/or modified sequence opt3 from hemagglutinin__InfluenzaA__AEO01044

SEQ ID NO: 129167 - RNA, 1701 nt, Artificial Sequence
  derived and/or modified sequence opt3 from hemagglutinin__InfluenzaA__AEO01045
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauuuggagugugaaucucucucaacagcaaguagcugguccuacauuguugagaccucuucgucagacaacggaacuugcuauccuggcgauuuuaucgacuacgaggagcugagggagcagcugagcaguguguccucuuucgaacgguuugagauuuucccaaagacaagcuccuggccgaaucacgauucaaacaagggugucaccgccgcuuguccccaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggacuucucgcuauuccaagaaauuuaagcccgagauugcaauccgaccuaaagugcgugaucaggagggaagaaugaauuacuauuggacccuaguggaaccaggugacaagauuacauucgaggccacuggcaaccucgucguucccagguacgcuuuugccauggaacggaacgcagggagcggaaucauaauuucggauaccccugugcaugacugcaauacaaccugucaaacgccaaaaggcgcuaucaacacuucucugccguuccagaauauucaccccaucacaaucgguaagugcccuaaguauguaaaauccaccaaacuucgccuggccacuggguugagaaacgugccaucaauucagaguaggggacucuuuggcgcgauagccggcuucaucgaagggggauggacagguauggucgacggcugguacggguaucaucaccagaaugaacaaggaagcggcuacgcagcugaucugaaauccacccagaacgccauugacgagaucacgaauaaggugaacucuguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauagcaauguaaagaaccucuacgagaagguucgaucacagcugaaaaacaaugcaaaggaaaucggcaacggauguuuugaguucuaucacaagugcgacaauacauguauggaaagugugaaaaacggcacuuacgauuaucccaaguacuccgaggaagccaaacuuaauagagaggagauugacggggucaagcuggaaagcaccaggaucuaucaaauuuuggcuauauacucuacaguggcgucaagucucguccuggugguuagcuuaggagcaaucuccuuuuggaugugcucuaacgguucgcugcagugccggauuuguaucuga

SEQ ID NO: 129168 - RNA, 1701 nt, Artificial Sequence; identical to SEQ ID NO: 124685
  derived and/or modified sequence opt3 from hemagglutinin__InfluenzaA__AEO01046

SEQ ID NO: 129169 - RNA, 1701 nt, Artificial Sequence; identical to SEQ ID NO: 124685
  derived and/or modified sequence opt3 from hemagglutinin__InfluenzaA__AEO01047

SEQ ID NO: 129170 - RNA, 1701 nt, Artificial Sequence
  derived and/or modified sequence opt3 from hemagglutinin__InfluenzaA__AEO01048
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugcaaaauuuguaucuga

SEQ ID NO: 129171 - RNA, 1701 nt, Artificial Sequence; identical to SEQ ID NO: 125583
  derived and/or modified sequence opt3 from hemagglutinin__InfluenzaA__AEO01049

SEQ ID NO: 129172 - RNA, 1701 nt, Artificial Sequence; identical to SEQ ID NO: 124685
  derived and/or modified sequence opt3 from hemagglutinin__InfluenzaA__AEO01050

SEQ ID NO: 129173 - RNA, 1701 nt, Artificial Sequence; identical to SEQ ID NO: 125038
  derived and/or modified sequence opt3 from hemagglutinin__InfluenzaA__AEO01051

SEQ ID NO: 129174 - RNA, 1701 nt, Artificial Sequence
  derived and/or modified sequence opt3 from hemagglutinin__InfluenzaA__AEO01052
augaaggccaucauugugguccugcucuacaccuucgcuacagcaaacgccgacacucuuugcauaggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacaagauaacgaauaaagugaacucuguuauugagaagaugaauacccaguuuacagcuguggguaaggaguucaaccaccucgaaaaacggaucgagaaucugaacaagaaagucgaugacggguucuuagauaucuggacuuacaaugccgaacugcucgugcuucuggagaacgaacgcaccuuggacuaucaugauagcaauguaaagaaccuauacgagaaaguucgaucacagcugaagaacaaugcaaaggagauuggcaacggauguuuugaguucuaucacaaaugcgacaauacauguauggagagugugaagaacggcacuuacgauuauccuaaauacuccgaagaggccaagcucaauagagaagagaucgacggggucaaacuggagagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 129175 - RNA, 1701 nt, Artificial Sequence; identical to SEQ ID NO: 125038
  derived and/or modified sequence opt3 from hemagglutinin__InfluenzaA__AEO01053

SEQ ID NO: 129176 - RNA, 1701 nt, Artificial Sequence; identical to SEQ ID NO: 124685
  derived and/or modified sequence opt3 from hemagglutinin__InfluenzaA__AEO01054

SEQ ID NO: 129177 - RNA, 1701 nt, Artificial Sequence; identical to SEQ ID NO: 125497
  derived and/or modified sequence opt3 from hemagglutinin__InfluenzaA__AEO01055

SEQ ID NO: 129178 - RNA, 1701 nt, Artificial Sequence; identical to SEQ ID NO: 125038
  derived and/or modified sequence opt3 from hemagglutinin__InfluenzaA__AEO01056

SEQ ID NO: 129179 - RNA, 1701 nt, Artificial Sequence; identical to SEQ ID NO: 124685
  derived and/or modified sequence opt3 from hemagglutinin__InfluenzaA__AEO01057

SEQ ID NO: 129180 - RNA, 1701 nt, Artificial Sequence; identical to SEQ ID NO: 124685
  derived and/or modified sequence opt3 from hemagglutinin__InfluenzaA__AEO01058

SEQ ID NO: 129181 - RNA, 1701 nt, Artificial Sequence; identical to SEQ ID NO: 124685
  derived and/or modified sequence opt3 from hemagglutinin__InfluenzaA__AEO01059

SEQ ID NO: 129182 - RNA, 1701 nt, Artificial Sequence; identical to SEQ ID NO: 124685
  derived and/or modified sequence opt3 from hemagglutinin__InfluenzaA__AEO01060

SEQ ID NO: 129183 - RNA, 1701 nt, Artificial Sequence; identical to SEQ ID NO: 124685
  derived and/or modified sequence opt3 from hemagglutinin__InfluenzaA__AEO01061

SEQ ID NO: 129184 - RNA, 1701 nt, Artificial Sequence; identical to SEQ ID NO: 124685
  derived and/or modified sequence opt3 from hemagglutinin__InfluenzaA__AEO01062

SEQ ID NO: 129185 - RNA, 1701 nt, Artificial Sequence; identical to SEQ ID NO: 124685
  derived and/or modified sequence opt3 from hemagglutinin__InfluenzaA__AEO01063

SEQ ID NO: 129186 - RNA, 1701 nt, Artificial Sequence; identical to SEQ ID NO: 124685
  derived and/or modified sequence opt3 from hemagglutinin__InfluenzaA__AEO01064

SEQ ID NO: 129187 - RNA, 1701 nt, Artificial Sequence; identical to SEQ ID NO: 124927
  derived and/or modified sequence opt3 from hemagglutinin__InfluenzaA__AEO01065

SEQ ID NO: 129188 - RNA, 1701 nt, Artificial Sequence; identical to SEQ ID NO: 125038
  derived and/or modified sequence opt3 from hemagglutinin__InfluenzaA__AEO01066

SEQ ID NO: 129189 - RNA, 1701 nt, Artificial Sequence
  derived and/or modified sequence opt3 from hemagglutinin__InfluenzaA__AEO01067
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauggcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacgagauuacgaauaaggugaacucuguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagaucgacggggucaaacuugaaagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 129190 - RNA, 1701 nt, Artificial Sequence; identical to SEQ ID NO: 125038
  derived and/or modified sequence opt3 from hemagglutinin__InfluenzaA__AEO01068

SEQ ID NO: 129191 - RNA, 1701 nt, Artificial Sequence; identical to SEQ ID NO: 124685
  derived and/or modified sequence opt3 from hemagglutinin__InfluenzaA__AEO01069

SEQ ID NO: 129192 - RNA, 1701 nt, Artificial Sequence; identical to SEQ ID NO: 125038
  derived and/or modified sequence opt3 from hemagglutinin__InfluenzaA__AEO01070

SEQ ID NO: 129193 - RNA, 1701 nt, Artificial Sequence; identical to SEQ ID NO: 124685
  derived and/or modified sequence opt3 from hemagglutinin__InfluenzaA__AEO01071

SEQ ID NO: 129194 - RNA, 1701 nt, Artificial Sequence
  derived and/or modified sequence opt3 from hemagglutinin__InfluenzaA__AEO01073
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuguaaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 129195 - RNA, 1701 nt, Artificial Sequence; identical to SEQ ID NO: 124927
  derived and/or modified sequence opt3 from hemagglutinin__InfluenzaA__AEO01074

SEQ ID NO: 129196 - RNA, 1701 nt, Artificial Sequence; identical to SEQ ID NO: 125038
  derived and/or modified sequence opt3 from hemagglutinin__InfluenzaA__AEO01075

SEQ ID NO: 129197 - RNA, 1701 nt, Artificial Sequence; identical to SEQ ID NO: 125038
  derived and/or modified sequence opt3 from hemagglutinin__InfluenzaA__AEO01076

SEQ ID NO: 129198 - RNA, 1701 nt, Artificial Sequence
  derived and/or modified sequence opt3 from hemagglutinin__InfluenzaA__AEO01077
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagaacgugaaaaauggcacuuacgacuauccuaaguacagugaagaggccaaacugaacagagaggaaauugauggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 129199 - RNA, 1701 nt, Artificial Sequence; identical to SEQ ID NO: 124685
  derived and/or modified sequence opt3 from hemagglutinin__InfluenzaA__AEO01078

SEQ ID NO: 129200 - RNA, 1701 nt, Artificial Sequence; identical to SEQ ID NO: 124685
  derived and/or modified sequence opt3 from hemagglutinin__InfluenzaA__AEO01079

SEQ ID NO: 129201 - RNA, 1701 nt, Artificial Sequence; identical to SEQ ID NO: 124685
  derived and/or modified sequence opt3 from hemagglutinin__InfluenzaA__AEO01080

SEQ ID NO: 129202 - RNA, 1701 nt, Artificial Sequence; identical to SEQ ID NO: 125038
  derived and/or modified sequence opt3 from hemagglutinin__InfluenzaA__AEO01081

SEQ ID NO: 129203 - RNA, 1701 nt, Artificial Sequence; identical to SEQ ID NO: 124685
  derived and/or modified sequence opt3 from hemagglutinin__InfluenzaA__AEO01082

SEQ ID NO: 129204 - RNA, 1701 nt, Artificial Sequence; identical to SEQ ID NO: 124685
  derived and/or modified sequence opt3 from hemagglutinin__InfluenzaA__AEO01083

SEQ ID NO: 129205 - RNA, 1701 nt, Artificial Sequence; identical to SEQ ID NO: 124685
  derived and/or modified sequence opt3 from hemagglutinin__InfluenzaA__AEO01084

SEQ ID NO: 129206 - RNA, 1701 nt, Artificial Sequence; identical to SEQ ID NO: 125038
  derived and/or modified sequence opt3 from hemagglutinin__InfluenzaA__AEO01085

SEQ ID NO: 129207 - RNA, 1701 nt, Artificial Sequence; identical to SEQ ID NO: 124685
  derived and/or modified sequence opt3 from hemagglutinin__InfluenzaA__AEO01086

SEQ ID NO: 129208 - RNA, 1701 nt, Artificial Sequence; identical to SEQ ID NO: 125038
  derived and/or modified sequence opt3 from hemagglutinin__InfluenzaA__AEO01087

SEQ ID NO: 129209 - RNA, 1701 nt, Artificial Sequence; identical to SEQ ID NO: 124865
  derived and/or modified sequence opt3 from hemagglutinin__InfluenzaA__AEO01088

SEQ ID NO: 129210 - RNA, 1701 nt, Artificial Sequence; identical to SEQ ID NO: 125038
  derived and/or modified sequence opt3 from hemagglutinin__InfluenzaA__AEO01089

SEQ ID NO: 129211 - RNA, 1701 nt, Artificial Sequence; identical to SEQ ID NO: 125038
  derived and/or modified sequence opt3 from hemagglutinin__InfluenzaA__AEO01090

SEQ ID NO: 129212 - RNA, 1701 nt, Artificial Sequence; identical to SEQ ID NO: 125038
  derived and/or modified sequence opt3 from hemagglutinin__InfluenzaA__AEO01091

SEQ ID NO: 129213 - RNA, 1701 nt, Artificial Sequence
  derived and/or modified sequence opt3 from hemagglutinin__InfluenzaA__AEO01092
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagcgaguaagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 129214 - RNA, 1701 nt, Artificial Sequence; identical to SEQ ID NO: 124685
  derived and/or modified sequence opt3 from hemagglutinin__InfluenzaA__AEO01093

SEQ ID NO: 129215 - RNA, 1701 nt, Artificial Sequence; identical to SEQ ID NO: 124685
  derived and/or modified sequence opt3 from hemagglutinin__InfluenzaA__AEO01094

SEQ ID NO: 129216 - RNA, 1701 nt, Artificial Sequence; identical to SEQ ID NO: 127892
  derived and/or modified sequence opt3 from hemagglutinin__InfluenzaA__AEO01095

SEQ ID NO: 129217 - RNA, 1701 nt, Artificial Sequence; identical to SEQ ID NO: 125038
  derived and/or modified sequence opt3 from hemagglutinin__InfluenzaA__AEO01096

SEQ ID NO: 129218 - RNA, 1701 nt, Artificial Sequence; identical to SEQ ID NO: 125038
  derived and/or modified sequence opt3 from hemagglutinin__InfluenzaA__AEO01097

SEQ ID NO: 129219 - RNA, 1701 nt, Artificial Sequence; identical to SEQ ID NO: 125038
  derived and/or modified sequence opt3 from hemagglutinin__InfluenzaA__AEO01098

SEQ ID NO: 129220 - RNA, 1701 nt, Artificial Sequence; identical to SEQ ID NO: 124685
  derived and/or modified sequence opt3 from hemagglutinin__InfluenzaA__AEO01099

SEQ ID NO: 129221 - RNA, 1701 nt, Artificial Sequence; identical to SEQ ID NO: 124927
  derived and/or modified sequence opt3 from hemagglutinin__InfluenzaA__AEO01100

SEQ ID NO: 129222 - RNA, 1701 nt, Artificial Sequence; identical to SEQ ID NO: 124685
  derived and/or modified sequence opt3 from hemagglutinin__InfluenzaA__AEO01101

SEQ ID NO: 129223 - RNA, 1701 nt, Artificial Sequence; identical to SEQ ID NO: 124685
  derived and/or modified sequence opt3 from hemagglutinin__InfluenzaA__AEO01102

SEQ ID NO: 129224 - RNA, 1701 nt, Artificial Sequence; identical to SEQ ID NO: 125038
  derived and/or modified sequence opt3 from hemagglutinin__InfluenzaA__AEO01103

SEQ ID NO: 129225 - RNA, 1701 nt, Artificial Sequence; identical to SEQ ID NO: 125038
  derived and/or modified sequence opt3 from hemagglutinin__InfluenzaA__AEO01104

SEQ ID NO: 129226 - RNA, 1701 nt, Artificial Sequence
  derived and/or modified sequence opt3 from hemagglutinin__InfluenzaA__AEO01105
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaguaagggugucaccgccgcuuguccucaugcaggggccaagagcuuuuauaagaaccugaucuggcucgugaaaaagggaaauucuuacccaaaauuauccaagucauauauaaacgacaagggcaaagaaguacugguucuuuggggcauccaccaccccagcacgagugcugaucaacagucuuuguaccagaaugccgacgcguacguguucgucgggacuucccgcuauagcaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucgggaaucauaauuucugauaccccagugcaugacugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacgagaucacgaacaaggugaauagcguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucaaacguuaaaaaucuguacgagaagguacgaagucagcucaaaaacaacgcaaaggaaaucggcaauggauguuuugaguucuaucacaagugcgacaacacauguauggaauccgugaaaaauggcacuuacgauuauccuaaguacagcgaggaagccaaacugaacagagaggagauugacggggucaaacuugaaucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 129227 - RNA, 1701 nt, Artificial Sequence; identical to SEQ ID NO: 125038
  derived and/or modified sequence opt3 from hemagglutinin__InfluenzaA__AEO01106

SEQ ID NO: 129228 - RNA, 1701 nt, Artificial Sequence; identical to SEQ ID NO: 124685
  derived and/or modified sequence opt3 from hemagglutinin__InfluenzaA__AEO01107

SEQ ID NO: 129229 - RNA, 1701 nt, Artificial Sequence; identical to SEQ ID NO: 124685
  derived and/or modified sequence opt3 from hemagglutinin__InfluenzaA__AEO01108

SEQ ID NO: 129230 - RNA, 1701 nt, Artificial Sequence; identical to SEQ ID NO: 124685
  derived and/or modified sequence opt3 from hemagglutinin__InfluenzaA__AEO01109

SEQ ID NO: 129231 - RNA, 1701 nt, Artificial Sequence; identical to SEQ ID NO: 124685
  derived and/or modified sequence opt3 from hemagglutinin__InfluenzaA__AEO01110

SEQ ID NO: 129232 - RNA, 1701 nt, Artificial Sequence; identical to SEQ ID NO: 124685
  derived and/or modified sequence opt3 from hemagglutinin__InfluenzaA__AEO01111

SEQ ID NO: 129233 - RNA, 1701 nt, Artificial Sequence; identical to SEQ ID NO: 124685
  derived and/or modified sequence opt3 from hemagglutinin__InfluenzaA__AEO01112

SEQ ID NO: 129234 - RNA, 1701 nt, Artificial Sequence
  derived and/or modified sequence opt3 from hemagglutinin__InfluenzaA__AEO01113
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggacuucucgcuauuccaagaaauuuaagcccgagauugcaauccgaccuaaagugcgugaucaggagggaagaaugaauuacuauuggacccuaguggaaccaggugacaagauuacauucgaggccacuggcaaccucgucguucccagguacgcuuuugccauggaacggaacgcagggagcggaaucauaauuucggauaccccugugcaugacugcaauacaaccugucaaacgccaaaaggcgcuaucaacacuucucugccguuccagaauauucaccccaucacaaucgguaagugcccuaaguauguaaaauccaccaaacuucgccuggccacuggguugagaaacgugccaucaauucagaguaggggacucuuuggcgcgauagccggcuucaucgaagggggauggacagguauggucgacggcugguacggguaucaucaccagaaugaacaaggaagcggcuacgcagcugaucugaaauccacccagaacgccauugacgagaucacgaauaaggugaacucuguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauagcaauguaaagaaccucuacgagaagguucgaucacagcugaaaaacaaugcaaaggaaaucggcaacggauguuuugaguucuaucacaagugcgacaauacauguauggaaagugugaaaaacggcacuuacgauuaucccaaguacuccgaggaagccaaacuuaauagagaggagauugacggggucaagcuggaaagcaccaggaucuaucaaauuuuggcuauauacucuacaguggcgucaagucucguccuggugguuagcuuaggagcaaucuccuuuuggaugugcucuaacgguucgcugcagugccggauuuguaucuga

SEQ ID NO: 129235 - RNA, 1701 nt, Artificial Sequence; identical to SEQ ID NO: 124927
  derived and/or modified sequence opt3 from hemagglutinin__InfluenzaA__AEO01114

SEQ ID NO: 129236 - RNA, 1701 nt, Artificial Sequence
  derived and/or modified sequence opt3 from hemagglutinin__InfluenzaA__AEO01115
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuugucugcaugcaggggccaagaguuuuuauaaaaaucucaucugguuagugaagaaaggaaacagcuacccuaagcugucuaaauccuauauaaaugacaagggcaaggagguacuuguuuuguggggcauccaccacccaucaacgagcgcugaucaacagagucuguaccagaacgccgacgcguacguguucgucgggacuucucgcuauuccaaaaaguuuaaacccgagauugcaauccgaccuaaggugcgugaucaggaaggaagaaugaauuacuauuggacccuaguggagccaggugacaaaauuacauucgaagccacuggcaaccucgucguucccagguacgcuuuugccauggagcggaacgcagggagcggaaucauaauuucggauaccccugugcaugacugcaauacaaccugucaaacgccaaagggcgcuaucaacacuucucugccguuccacaauauucaucccaucacaaucgguaaaugcccuaaguauguaaaguccaccaaacuucgccuggccacuggguugagaaacgugccaucaauucagaguaggggacucuuuggcgcgauagccggcuucaucgaagggggauggacagguauggucgacggcugguacggguaucaccaccagaaugagcagggaagcggcuacgcagcugaucugaaguccacccaaaacgccauugacgagaucacgaauaaagugaacucuguuauagaaaagaugaauacccaguuuacagcuguggguaaagaguucaaccauuuagaaaagcggauugagaaucugaacaagaaagucgaugacggguuccucgauaucuggacuuacaaugccgaacuucugguguugcuagagaacgagcgcacccuggacuaucacgauagcaauguaaagaaccucuacgaaaaaguucgaucacagcugaagaacaaugcaaaagagaucggcaacggauguuuugaguucuaucauaagugcgacaauacauguauggaaagugugaagaacggcacuuacgauuaucccaaauacuccgaagaggccaaacuuaauagagaggaaauugacggggucaagcuggagagcaccaggaucuaucagauuuuggcuauauacucuacaguggcgucaagucucguccuggugguuagcuuaggagcaaucuccuuuuggaugugcucuaacgguucgcugcaaugccggauuuguaucuga

SEQ ID NO: 129237 - RNA, 1701 nt, Artificial Sequence; identical to SEQ ID NO: 124685
  derived and/or modified sequence opt3 from hemagglutinin__InfluenzaA__AEO01116

SEQ ID NO: 129238 - RNA, 1701 nt, Artificial Sequence; identical to SEQ ID NO: 124685
  derived and/or modified sequence opt3 from hemagglutinin__InfluenzaA__AEO01117

SEQ ID NO: 129239 - RNA, 1701 nt, Artificial Sequence; identical to SEQ ID NO: 125551
  derived and/or modified sequence opt3 from hemagglutinin__InfluenzaA__AEO01118

SEQ ID NO: 129240 - RNA, 1701 nt, Artificial Sequence; identical to SEQ ID NO: 124685
  derived and/or modified sequence opt3 from hemagglutinin__InfluenzaA__AEO01119

SEQ ID NO: 129241 - RNA, 1701 nt, Artificial Sequence
  derived and/or modified sequence opt3 from hemagglutinin__InfluenzaA__AEO01120
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugagcaaggaagcggcuacgcagcugaccucaaauccacccagaacgccaucgaugagauaacgaauaaggucaacucugugauugaaaagaugaauacccaguuuacagcuguugguaaggaguucaaccaccuggaaaagcggaucgagaauuuaaacaaaaagguggacgauggguuccuggacgucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129242 - RNA, 1701 nt, Artificial Sequence; identical to SEQ ID NO: 124685
  derived and/or modified sequence opt3 from hemagglutinin__InfluenzaA__AEO01121

SEQ ID NO: 129243 - RNA, 1701 nt, Artificial Sequence; identical to SEQ ID NO: 125038
  derived and/or modified sequence opt3 from hemagglutinin__InfluenzaA__AEO01122

SEQ ID NO: 129244 - RNA, 1701 nt, Artificial Sequence; identical to SEQ ID NO: 124685
  derived and/or modified sequence opt3 from hemagglutinin__InfluenzaA__AEO01123

SEQ ID NO: 129245 - RNA, 1701 nt, Artificial Sequence; identical to SEQ ID NO: 124685
  derived and/or modified sequence opt3 from hemagglutinin__InfluenzaA__AEO01124

SEQ ID NO: 129246 - RNA, 1701 nt, Artificial Sequence; identical to SEQ ID NO: 125038
  derived and/or modified sequence opt3 from hemagglutinin__InfluenzaA__AEO01125

SEQ ID NO: 129247 - RNA, 1701 nt, Artificial Sequence
  derived and/or modified sequence opt3 from hemagglutinin__InfluenzaA__AEO01126
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauugacuacgaagaacucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccaaaagugcgugagcaggaaggaagaaugaauuacuauuggacacugguggagcccggugauaagaucacuuucgaagccaccggcaaccuagucguuccuagguacgcuuuugccauggagcggaacgcagggagcggaauuaucauaucggacacaccagugcaugauugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugagcaaggaagcggcuacgcagcugaccucaaauccacgcagaacgccaucgaugagauuaccaauaaggugaacucuguuaucgaaaagaugaauacacaguuuacugcuguggguaaggaguucaaccaccuggaaaagcggauagagaauuuaaacaaaaaggucgacgauggguuccuggacauuuggaccuacaaugccgaacuccuugugcuguuggagaacgagcgcacacuagauuaucaugacagcaauguuaaaaaccuguacgaaaagguacgaucacagcucaaaaacaaugcaaaggagaucggcaacggauguuuugaguucuaucacaagugcgauaauacuuguauggagagugugaaaaacggcaccuacgacuauccuaaguacuccgaagaggccaaacugaauagagaggaaaucgauggggucaaacuugagagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 129248 - RNA, 1701 nt, Artificial Sequence; identical to SEQ ID NO: 124685
  derived and/or modified sequence opt3 from hemagglutinin__InfluenzaA__AEO01127

SEQ ID NO: 129249 - RNA, 1701 nt, Artificial Sequence; identical to SEQ ID NO: 124685
  derived and/or modified sequence opt3 from hemagglutinin__InfluenzaA__AEO01128

SEQ ID NO: 129250 - RNA, 1701 nt, Artificial Sequence; identical to SEQ ID NO: 125038
  derived and/or modified sequence opt3 from hemagglutinin__InfluenzaA__AEO01129

SEQ ID NO: 129251 - RNA, 1701 nt, Artificial Sequence; identical to SEQ ID NO: 124685
  derived and/or modified sequence opt3 from hemagglutinin__InfluenzaA__AEO01130

SEQ ID NO: 129252 - RNA, 1701 nt, Artificial Sequence; identical to SEQ ID NO: 125038
  derived and/or modified sequence opt3 from hemagglutinin__InfluenzaA__AEO01131

SEQ ID NO: 129253 - RNA, 1701 nt, Artificial Sequence; identical to SEQ ID NO: 124685
  derived and/or modified sequence opt3 from hemagglutinin__InfluenzaA__AEO01132

SEQ ID NO: 129254 - RNA, 1701 nt, Artificial Sequence
  derived and/or modified sequence opt3 from hemagglutinin__InfluenzaA__AEO01133
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaugauuuaucaaauacuugcuaucuacucaaccguggcgaguagccuggucuuggugguuucccucggagcaauuucuuuuuggaugugcucgaacgguagccugcagugcaggaucuguaucuga

SEQ ID NO: 129255 - RNA, 1701 nt, Artificial Sequence; identical to SEQ ID NO: 125038
  derived and/or modified sequence opt3 from hemagglutinin__InfluenzaA__AEO01134

SEQ ID NO: 129256 - RNA, 1701 nt, Artificial Sequence; identical to SEQ ID NO: 125038
  derived and/or modified sequence opt3 from hemagglutinin__InfluenzaA__AEO01135

SEQ ID NO: 129257 - RNA, 1701 nt, Artificial Sequence; identical to SEQ ID NO: 124685
  derived and/or modified sequence opt3 from hemagglutinin__InfluenzaA__AEO01136

SEQ ID NO: 129258 - RNA, 1701 nt, Artificial Sequence; identical to SEQ ID NO: 125132
  derived and/or modified sequence opt3 from hemagglutinin__InfluenzaA__AEO01137

SEQ ID NO: 129259 - RNA, 1701 nt, Artificial Sequence; identical to SEQ ID NO: 125132
  derived and/or modified sequence opt3 from hemagglutinin__InfluenzaA__AEO01138

SEQ ID NO: 129260 - RNA, 1701 nt, Artificial Sequence; identical to SEQ ID NO: 124685
  derived and/or modified sequence opt3 from hemagglutinin__InfluenzaA__AEO01139

SEQ ID NO: 129261 - RNA, 1701 nt, Artificial Sequence; identical to SEQ ID NO: 124685
  derived and/or modified sequence opt3 from hemagglutinin__InfluenzaA__AEO01140

SEQ ID NO: 129262 - RNA, 1701 nt, Artificial Sequence; identical to SEQ ID NO: 124685
  derived and/or modified sequence opt3 from hemagglutinin__InfluenzaA__AEO01141

SEQ ID NO: 129263 - RNA, 1701 nt, Artificial Sequence; identical to SEQ ID NO: 124685
  derived and/or modified sequence opt3 from hemagglutinin__InfluenzaA__AEO01142

SEQ ID NO: 129264 - RNA, 1701 nt, Artificial Sequence
  derived and/or modified sequence opt3 from hemagglutinin__InfluenzaA__AEO01144
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaagaacucagggagcagcugucaagcgugaguuccuucgaacgguuugagaucuucccgaagacaucuagcuggcccaaucacgauuccaacaagggugucaccgccgcuuguccucaugcaggggccaaaggauuuuauaagaaucugauauggcucgugaaaaagggcaacucauacccaaaauuaaguaagagcuauaucaaugacaagggcaaagaaguacugguucuuugggggauucaccaccccucuacguccgcugaucaacagucauuguaccagaacgccgacgcguacguguucgucggaacuagccgcuauaguaagaaauuuaagccugagaucgcaauucgaccaaaagugcgugaucaggaggguagaaugaauuacuauuggacccugguggaacccggcgacaagaucacauucgaggccacugggaaccuagucguuccuagguacgcuuuugccauggaacggaacgcaggaucuggcauaauuaucuccgauaccccagugcaugacugcaauacaaccugucaaacgccgaaaggugcuauuaacacuagccuccccuuccagaauauccacccuaucacaauugggaagugcccaaaguauguaaaaucgaccaagcugcgccuugccacuggacugagaaacgugcccucuauacaguccaggggcuuguuuggcgcgaucgccggguucauugagggagguuggacaggcauggucgacgggugguacggauaucaucaccagaaugaacaaggcucagguuacgcagcugaucucaaaaguacccagaacgccaucgacgagauaacgaauaaggugaacagcguuauugagaaaaugaauacccaguuuacagcuguggggaaggaguucaaccaccuggagaagcggaucgaaaauuuaaacaaaaaggucgaugacggcuuccuggauaucuggacuuacaaugccgagcuccuugugcuguuggaaaacgagcgcacccuagacuaucaugauuccaauguaaagaaccuguacgagaagguucgaucucagcucaaaaacaaugcaaaggaaauuggaaacggcuguuuugaguucuaucacaagugcgacaauacauguauggaaagcgugaaaaacgggacuuacgauuauccuaaguacucagaggaagccaaacugaauagagaggagaucgacggagucaaacuugaaaguaccaggauuuaucaaauacuggcuaucuacuccacaguggcgagcucuuugguccucgugguuucacugggugcaauuaguuuuuggaugugcagcaacggcuccuuacagugccggaucuguaucuga

SEQ ID NO: 129265 - RNA, 1701 nt, Artificial Sequence; identical to SEQ ID NO: 124865
  derived and/or modified sequence opt3 from hemagglutinin__InfluenzaA__AEO01145

SEQ ID NO: 129266 - RNA, 1701 nt, Artificial Sequence
  derived and/or modified sequence opt3 from hemagglutinin__InfluenzaA__AEO01146
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaauccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129267 - RNA, 1701 nt, Artificial Sequence; identical to SEQ ID NO: 124685
  derived and/or modified sequence opt3 from hemagglutinin__InfluenzaA__AEO01147

SEQ ID NO: 129268 - RNA, 1701 nt, Artificial Sequence; identical to SEQ ID NO: 125038
  derived and/or modified sequence opt3 from hemagglutinin__InfluenzaA__AEO01148

SEQ ID NO: 129269 - RNA, 1701 nt, Artificial Sequence; identical to SEQ ID NO: 125038
  derived and/or modified sequence opt3 from hemagglutinin__InfluenzaA__AEO01149

SEQ ID NO: 129270 - RNA, 1701 nt, Artificial Sequence; identical to SEQ ID NO: 127892
  derived and/or modified sequence opt3 from hemagglutinin__InfluenzaA__AEO01150

SEQ ID NO: 129271 - RNA, 1701 nt, Artificial Sequence; identical to SEQ ID NO: 124685
  derived and/or modified sequence opt3 from hemagglutinin__InfluenzaA__AEO01151

SEQ ID NO: 129272 - RNA, 1701 nt, Artificial Sequence
  derived and/or modified sequence opt3 from hemagglutinin__InfluenzaA__AEO01152
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccguggacaggaggguagaaugaauuacuauuggacccugguggaacccggcgauaagaucacauucgaggccacugggaaccuaguggucccuagguacgcuuuugccauggaacggaacgcaggaagcggcauaauuaucucggacaccccaguucaugauugcaauacaaccugucaaacgccgaaaggugcuauuaacacuucucuccccuuccagaauauccacccuaucacaauugggaagugcccaaaguaugugaaauccaccaagcugcgccuugccacuggacugagaaacguacccucaauacagaguaggggcuuguuuggcgcgaucgccggguucauugagggagguuggacaggcaugguggacgggugguacggauaucaucaccagaaugaacaaggcagcgguuacgcagcugaccucaaauccacccagaacgccaucgaugagauaacgaauaaggucaacucugugauugagaaaaugaauacccaguuuacagcuguugggaaggaguucaaccaccuggagaagcggaucgaaaauuuaaacaaaaagguggacgauggcuuccuggacaucuggacuuacaaugccgagcuccuuguccuguuggaaaacgagcgcacccuagauuaucaugacagcaaugugaaaaaccuguacgagaagguacgaucacagcucaaaaacaaugcaaaggaaauuggaaacggcuguuuugaguucuaucacaagugcgauaauacauguauggaaaguguuaaaaacgggacuuacgacuauccuaaguacuccgaggaagccaaacugaauagagaggagaucgauggagugaaacuugaaagcaccaggauuuaucaaauacuggcuaucuacucuacagucgcgucaaguuuggugcucgucgugagccugggugcaauuuccuuuuggaugugcucuaacggcucguuacagugccggaucuguaucuga

SEQ ID NO: 129273 - RNA, 1701 nt, Artificial Sequence
  derived and/or modified sequence opt3 from hemagglutinin__InfluenzaA__AEO01153
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaauaacaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucgaacaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgauggcugguacggguaucaucaccagaaugaacaaggaagcggcuacgcagcugaccucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaacguaaagaaucuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129274 - RNA, 1701 nt, Artificial Sequence; identical to SEQ ID NO: 124685
  derived and/or modified sequence opt3 from hemagglutinin__InfluenzaA__AEO01154

SEQ ID NO: 129275 - RNA, 1701 nt, Artificial Sequence; identical to SEQ ID NO: 125038
  derived and/or modified sequence opt3 from hemagglutinin__InfluenzaA__AEO01155

SEQ ID NO: 129276 - RNA, 1701 nt, Artificial Sequence; identical to SEQ ID NO: 125038
  derived and/or modified sequence opt3 from hemagglutinin__InfluenzaA__AEO01156

SEQ ID NO: 129277 - RNA, 1701 nt, Artificial Sequence; identical to SEQ ID NO: 124685
  derived and/or modified sequence opt3 from hemagglutinin__InfluenzaA__AEO01157

SEQ ID NO: 129278 - RNA, 1701 nt, Artificial Sequence; identical to SEQ ID NO: 124685
  derived and/or modified sequence opt3 from hemagglutinin__InfluenzaA__AEO01158

SEQ ID NO: 129279 - RNA, 1701 nt, Artificial Sequence; identical to SEQ ID NO: 124685
  derived and/or modified sequence opt3 from hemagglutinin__InfluenzaA__AEO01159

SEQ ID NO: 129280 - RNA, 1701 nt, Artificial Sequence
  derived and/or modified sequence opt3 from hemagglutinin__InfluenzaA__AEO01160
augaaggccauccugguggcucuccuuuacaccuucgcaacagccaacgcggacacucugugcauuggcuaucacgcuaauaacagcacggauaccgucgacacaguuuuggagaaaaaugugacuguaacccauuccgugaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaagaacucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugagcaggaaggaagaaugaauuacuauuggacccugguggagcccggugauaagauuacauucgaagcuacuggcaaccuaguggucccuagguacgccuuugcaauggagcggaacgcugggagcggaaucauaauuucggacaccccaguucaugauugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugagcaaggaagcggcuacgcugccgaccucaaauccacccagaacgcuauugaugagaucacgaauaaggucaacucugugauagaaaagaugaauacccaguuuacagccguugguaaggaguucaaccaccuggaaaagcggauugagaauuuaaacaaaaagguggacgauggguuccuggacaucuggacuuacaaugcagaacuccuuguccuguuggagaacgagcgcacccuagauuaucaugacagcaaugugaaaaaccuguacgaaaagguacgaucacagcucaaaaacaaugccaaggagaucggcaacggauguuuugaguucuaucacaagugcgauaauacauguauggagaguguuaaaaacggcacuuacgacuauccuaaguacuccgaagaggcuaaacugaauagagaggaaauugauggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 129281 - RNA, 1701 nt, Artificial Sequence; identical to SEQ ID NO: 124685
  derived and/or modified sequence opt3 from hemagglutinin__InfluenzaA__AEO01161

SEQ ID NO: 129282 - RNA, 1701 nt, Artificial Sequence; identical to SEQ ID NO: 125038
  derived and/or modified sequence opt3 from hemagglutinin__InfluenzaA__AEO01162

SEQ ID NO: 129283 - RNA, 1701 nt, Artificial Sequence; identical to SEQ ID NO: 125038
  derived and/or modified sequence opt3 from hemagglutinin__InfluenzaA__AEO01163

SEQ ID NO: 129284 - RNA, 1701 nt, Artificial Sequence; identical to SEQ ID NO: 125038
  derived and/or modified sequence opt3 from hemagglutinin__InfluenzaA__AEO01164

SEQ ID NO: 129285 - RNA, 1701 nt, Artificial Sequence
  derived and/or modified sequence opt3 from hemagglutinin__InfluenzaA__AEO01165
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauucucuaaguccuauauaaaugacaagggcaaagaaguauuaguucuguggggcauccaccaccccucaacgagcgcugaucaacagagucuuuaccagaacgccgacgcguacguguuugucgggacuucucgcuauuccaagaaauucaagccugagauugcaauccgaccaaaagugcgugaucaggagggaagaaugaauuacuauuggaccuugguggaacccggugacaagauuacauuugaggccacuggcaaccuggucguuccuagguacgcuuucgccauggaacggaacgcagggagcggaaucauaauuucggauaccccagugcaugacugcaauacaaccugucaaacgccgaaaggcgcuaucaacacuucucuacccuuucagaauauucacccuaucacaaucgguaagugcccaaaguauguaaaauccaccaagcuccgccuggccacugggcuuagaaacgugcccucaauucagaguaggggacuguucggcgcgauagccggcuuuaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguucacagcuguggguaaggaguucaaccaccucgaaaagcggauugaaaaucugaacaaaaaggucgaugacggguuuuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuucgaguuuuaucacaagugcgacaauacauguauggaaagugugaaaaacggcacuuacgauuauccuaaguacuccgaggaagccaaacucaauagagaggagauugacggggucaagcuggaaagcaccaggaucuaucaaauucuugcuauauacucuacaguggcgucaagucuggucuuggugguuagccucggagcaaucuccuucuggaugugcucuaacgguucgcugcagugccggauuuguaucuga

SEQ ID NO: 129286 - RNA, 1701 nt, Artificial Sequence; identical to SEQ ID NO: 125038
  derived and/or modified sequence opt3 from hemagglutinin__InfluenzaA__AEO01166

SEQ ID NO: 129287 - RNA, 1701 nt, Artificial Sequence
  derived and/or modified sequence opt3 from hemagglutinin__InfluenzaA__AEO01167
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccucugugcaugauugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguacgaagucagcucaaaaacaaugcaaaggagaucggcaacggauguuuugaguucuaucacaagugcgauaauacauguauggaguccgugaaaaacggcacuuacgacuaucccaaguacagcgaagaggccaaacugaauagagaggaaauugauggggucaaacuugagucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 129288 - RNA, 1701 nt, Artificial Sequence; identical to SEQ ID NO: 124685
  derived and/or modified sequence opt3 from hemagglutinin__InfluenzaA__AEO01168

SEQ ID NO: 129289 - RNA, 1701 nt, Artificial Sequence; identical to SEQ ID NO: 125038
  derived and/or modified sequence opt3 from hemagglutinin__InfluenzaA__AEO01169

SEQ ID NO: 129290 - RNA, 1701 nt, Artificial Sequence; identical to SEQ ID NO: 125038
  derived and/or modified sequence opt3 from hemagglutinin__InfluenzaA__AEO01170

SEQ ID NO: 129291 - RNA, 1701 nt, Artificial Sequence; identical to SEQ ID NO: 125038
  derived and/or modified sequence opt3 from hemagglutinin__InfluenzaA__AEO01171

SEQ ID NO: 129292 - RNA, 1701 nt, Artificial Sequence; identical to SEQ ID NO: 124685
  derived and/or modified sequence opt3 from hemagglutinin__InfluenzaA__AEO01172

SEQ ID NO: 129293 - RNA, 1701 nt, Artificial Sequence
  derived and/or modified sequence opt3 from hemagglutinin__InfluenzaA__AEO01173
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccgguggcaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugauggagucaaacuugaaagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 129294 - RNA, 1701 nt, Artificial Sequence
  derived and/or modified sequence opt3 from hemagglutinin__InfluenzaA__AEO01174
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugagcaggaagguagaaugaauuacuauuggacccugguggagcccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgaugggugguacggauaucaucaccagaaugagcaaggcagcgguuacgcagcugaccucaaauccacccagaacgccauugacgagaucacgaauaaggugaacucuguuauagaaaagaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucggaaacggcuguuuugaguucuaucacaagugcgacaauacauguauggagagugugaaaaacgggacuuacgauuauccuaaguacuccgaagaggccaaacugaauagagaggaaauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 129295 - RNA, 1701 nt, Artificial Sequence; identical to SEQ ID NO: 124685
  derived and/or modified sequence opt3 from hemagglutinin__InfluenzaA__AEO01176

SEQ ID NO: 129296 - RNA, 1701 nt, Artificial Sequence; identical to SEQ ID NO: 124685
  derived and/or modified sequence opt3 from hemagglutinin__InfluenzaA__AEO01177

SEQ ID NO: 129297 - RNA, 1701 nt, Artificial Sequence; identical to SEQ ID NO: 125038
  derived and/or modified sequence opt3 from hemagglutinin__InfluenzaA__AEO01179

SEQ ID NO: 129298 - RNA, 1701 nt, Artificial Sequence; identical to SEQ ID NO: 125038
  derived and/or modified sequence opt3 from hemagglutinin__InfluenzaA__AEO01180

SEQ ID NO: 129299 - RNA, 1701 nt, Artificial Sequence; identical to SEQ ID NO: 125038
  derived and/or modified sequence opt3 from hemagglutinin__InfluenzaA__AEO01181

SEQ ID NO: 129300 - RNA, 1701 nt, Artificial Sequence; identical to SEQ ID NO: 125038
  derived and/or modified sequence opt3 from hemagglutinin__InfluenzaA__AEO01182

SEQ ID NO: 129301 - RNA, 1701 nt, Artificial Sequence; identical to SEQ ID NO: 124685
  derived and/or modified sequence opt3 from hemagglutinin__InfluenzaA__AEO01183

SEQ ID NO: 129302 - RNA, 1701 nt, Artificial Sequence; identical to SEQ ID NO: 125038
  derived and/or modified sequence opt3 from hemagglutinin__InfluenzaA__AEO01184

SEQ ID NO: 129303 - RNA, 1701 nt, Artificial Sequence; identical to SEQ ID NO: 124685
  derived and/or modified sequence opt3 from hemagglutinin__InfluenzaA__AEO01185

SEQ ID NO: 129304 - RNA, 1701 nt, Artificial Sequence; identical to SEQ ID NO: 124685
  derived and/or modified sequence opt3 from hemagglutinin__InfluenzaA__AEO01186

SEQ ID NO: 129305 - RNA, 1701 nt, Artificial Sequence; identical to SEQ ID NO: 124685
  derived and/or modified sequence opt3 from hemagglutinin__InfluenzaA__AEO01187

SEQ ID NO: 129306 - RNA, 1701 nt, Artificial Sequence; identical to SEQ ID NO: 124685
  derived and/or modified sequence opt3 from hemagglutinin__InfluenzaA__AEO01188

SEQ ID NO: 129307 - RNA, 1701 nt, Artificial Sequence; identical to SEQ ID NO: 124685
  derived and/or modified sequence opt3 from hemagglutinin__InfluenzaA__AEO01189

SEQ ID NO: 129308 - RNA, 1701 nt, Artificial Sequence; identical to SEQ ID NO: 124685
  derived and/or modified sequence opt3 from hemagglutinin__InfluenzaA__AEO01191

SEQ ID NO: 129309 - RNA, 1701 nt, Artificial Sequence; identical to SEQ ID NO: 124685
  derived and/or modified sequence opt3 from hemagglutinin__InfluenzaA__AEO01192

SEQ ID NO: 129310 - RNA, 1701 nt, Artificial Sequence; identical to SEQ ID NO: 125999
  derived and/or modified sequence opt3 from hemagglutinin__InfluenzaA__AEO01193

SEQ ID NO: 129311 - RNA, 1701 nt, Artificial Sequence; identical to SEQ ID NO: 125038
  derived and/or modified sequence opt3 from hemagglutinin__InfluenzaA__AEO01194

SEQ ID NO: 129312 - RNA, 1701 nt, Artificial Sequence; identical to SEQ ID NO: 125038
  derived and/or modified sequence opt3 from hemagglutinin__InfluenzaA__AEO01195

SEQ ID NO: 129313 - RNA, 1701 nt, Artificial Sequence; identical to SEQ ID NO: 124685
  derived and/or modified sequence opt3 from hemagglutinin__InfluenzaA__AEO01196

SEQ ID NO: 129314 - RNA, 1701 nt, Artificial Sequence; identical to SEQ ID NO: 124685
  derived and/or modified sequence opt3 from hemagglutinin__InfluenzaA__AEO01197

SEQ ID NO: 129315 - RNA, 1701 nt, Artificial Sequence; identical to SEQ ID NO: 125038
  derived and/or modified sequence opt3 from hemagglutinin__InfluenzaA__AEO01198

SEQ ID NO: 129316 - RNA, 1701 nt, Artificial Sequence; identical to SEQ ID NO: 125551
  derived and/or modified sequence opt3 from hemagglutinin__InfluenzaA__AEO01200

SEQ ID NO: 129317 - RNA, 1701 nt, Artificial Sequence
  derived and/or modified sequence opt3 from hemagglutinin__InfluenzaA__AEO01201
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagagaagcacaaugggaaacuauguaagcucagaggaguggcuccccugcaucuugguaaaugcaacauagccggcuggauccuggggaauccugaaugugagucuuugucaacagcaaguagcugguccuacauuguugaaaccucuucgucagauaacggaacuugcuauccaggcgacuuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaacaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgauggcugguacggguaucaucaccagaaugagcaaggaagcggcuacgcagcugaccucaaauccacccagaacgccauugacgaaaucacgaauaaggugaacucuguuauagagaaaaugaauacccaguuuacagcuguggguaaggaguucaaccaccuggagaagcggauugaaaauuuaaacaaaaaggucgaugacggguuccuggauaucuggacuuacaaugccgagcuccuugugcuguuggagaacgaacgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaggccaaacugaauagagaagagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129318 - RNA, 1701 nt, Artificial Sequence; identical to SEQ ID NO: 124685
  derived and/or modified sequence opt3 from hemagglutinin__InfluenzaA__AEO01202

SEQ ID NO: 129319 - RNA, 1701 nt, Artificial Sequence; identical to SEQ ID NO: 126321
  derived and/or modified sequence opt3 from hemagglutinin__InfluenzaA__AEO01203

SEQ ID NO: 129320 - RNA, 1701 nt, Artificial Sequence; identical to SEQ ID NO: 124685
  derived and/or modified sequence opt3 from hemagglutinin__InfluenzaA__AEO01204

SEQ ID NO: 129321 - RNA, 1701 nt, Artificial Sequence; identical to SEQ ID NO: 124685
  derived and/or modified sequence opt3 from hemagglutinin__InfluenzaA__AEO01205

SEQ ID NO: 129322 - RNA, 1701 nt, Artificial Sequence; identical to SEQ ID NO: 124685
  derived and/or modified sequence opt3 from hemagglutinin__InfluenzaA__AEO01206

SEQ ID NO: 129323 - RNA, 1701 nt, Artificial Sequence; identical to SEQ ID NO: 124685
  derived and/or modified sequence opt3 from hemagglutinin__InfluenzaA__AEO01207

SEQ ID NO: 129324 - RNA, 1701 nt, Artificial Sequence; identical to SEQ ID NO: 124685
  derived and/or modified sequence opt3 from hemagglutinin__InfluenzaA__AEO01208
